United States Patent
Ghayur et al.

(10) Patent No.: US 9,493,560 B2
(45) Date of Patent: Nov. 15, 2016

(54) DUAL VARIABLE DOMAIN IMMUNOGLOBULINS AND USES THEREOF

(71) Applicant: AbbVie, Inc., North Chicago, IL (US)

(72) Inventors: Tariq Ghayur, Holliston, MA (US); Junjian Liu, Shrewsbury, MA (US); Peter C. Isakson, Southborough, MA (US)

(73) Assignee: AbbVie Inc., North Chicago, IL (US)

( * ) Notice: Subject to any disclaimer, the term of this patent is extended or adjusted under 35 U.S.C. 154(b) by 80 days.

(21) Appl. No.: 14/135,107

(22) Filed: Dec. 19, 2013

(65) Prior Publication Data

US 2014/0234208 A1    Aug. 21, 2014

Related U.S. Application Data

(62) Division of application No. 13/196,138, filed on Aug. 2, 2011, now Pat. No. 8,735,546.

(60) Provisional application No. 61/377,134, filed on Aug. 26, 2010, provisional application No. 61/370,269, filed on Aug. 3, 2010.

(51) Int. Cl.
| | |
|---|---|
| *A61K 39/395* | (2006.01) |
| *A61K 39/40* | (2006.01) |
| *C07K 16/24* | (2006.01) |
| *C07K 16/46* | (2006.01) |
| *G01N 33/53* | (2006.01) |
| *G01N 33/68* | (2006.01) |
| *A61K 45/06* | (2006.01) |
| *A61K 47/48* | (2006.01) |
| *A61K 49/00* | (2006.01) |
| *A61K 51/10* | (2006.01) |
| *G01N 33/569* | (2006.01) |
| *C07K 16/00* | (2006.01) |

(52) U.S. Cl.
CPC ......... *C07K 16/244* (2013.01); *A61K 39/3955* (2013.01); *A61K 45/06* (2013.01); *A61K 47/48546* (2013.01); *A61K 49/00* (2013.01); *A61K 51/1021* (2013.01); *C07K 16/241* (2013.01); *C07K 16/245* (2013.01); *C07K 16/468* (2013.01); *G01N 33/53* (2013.01); *G01N 33/56966* (2013.01); *G01N 33/6857* (2013.01); *G01N 33/6869* (2013.01); *C07K 2317/35* (2013.01); *C07K 2317/76* (2013.01); *C07K 2317/92* (2013.01); *C07K 2317/94* (2013.01); *G01N 2333/54* (2013.01); *G01N 2333/545* (2013.01); *G01N 2800/24* (2013.01); *G01N 2800/7028* (2013.01)

(58) Field of Classification Search
None
See application file for complete search history.

(56) References Cited

U.S. PATENT DOCUMENTS

| | | |
|---|---|---|
| 4,526,938 A | 7/1985 | Churchill et al. |
| 4,554,101 A | 11/1985 | Hopp |
| 4,699,784 A | 10/1987 | Shih et al. |
| 4,753,894 A | 6/1988 | Frankel et al. |
| 4,816,567 A | 3/1989 | Cabilly et al. |
| 4,880,780 A | 11/1989 | Trainor et al. |
| 4,943,533 A | 7/1990 | Mendelsohn et al. |
| 4,946,778 A | 8/1990 | Ladner et al. |
| 4,980,286 A | 12/1990 | Morgan et al. |
| 5,006,309 A | 4/1991 | Khalil et al. |
| 5,063,081 A | 11/1991 | Cozzette et al. |
| 5,089,424 A | 2/1992 | Khalil et al. |
| 5,128,326 A | 7/1992 | Balazs et al. |
| 5,223,409 A | 6/1993 | Ladner et al. |
| 5,225,539 A | 7/1993 | Winter |
| 5,258,498 A | 11/1993 | Huston et al. |
| 5,290,540 A | 3/1994 | Prince et al. |
| 5,294,404 A | 3/1994 | Grandone et al. |
| 5,403,484 A | 4/1995 | Ladner et al. |
| 5,427,908 A | 6/1995 | Dower et al. |
| 5,500,362 A | 3/1996 | Robinson et al. |
| 5,516,637 A | 5/1996 | Huang et al. |
| 5,530,101 A | 6/1996 | Queen et al. |
| 5,558,864 A | 9/1996 | Bendig et al. |
| 5,565,332 A | 10/1996 | Hoogenboom et al. |
| 5,565,352 A | 10/1996 | Hochstrasser et al. |
| 5,571,698 A | 11/1996 | Ladner et al. |
| 5,580,717 A | 12/1996 | Dower et al. |
| 5,585,089 A | 12/1996 | Queen et al. |
| 5,624,821 A | 4/1997 | Winter et al. |
| 5,627,052 A | 5/1997 | Schrader |
| 5,641,870 A | 6/1997 | Rinderknecht et al. |
| 5,648,260 A | 7/1997 | Winter et al. |
| 5,656,272 A | 8/1997 | Le et al. |
| 5,658,727 A | 8/1997 | Barbas et al. |
| 5,677,171 A | 10/1997 | Hudziak et al. |

(Continued)

FOREIGN PATENT DOCUMENTS

| | | |
|---|---|---|
| CN | 1276428 A | 12/2000 |
| CN | 101058609 A | 10/2007 |

(Continued)

OTHER PUBLICATIONS

Kellner. Therapeutic Advances in Musculoskeletal Disease, 2013 5(3):141-152.*

(Continued)

*Primary Examiner* — Chun Dahle

(74) *Attorney, Agent, or Firm* — Sterne, Kessler, Goldstein & Fox P.L.L.C.

(57) ABSTRACT

Engineered multivalent and multispecific binding proteins, methods of making, and their uses in the prevention, diagnosis, and/or treatment of disease are provided.

6 Claims, 1 Drawing Sheet

(56) References Cited

U.S. PATENT DOCUMENTS

| | | |
|---|---|---|
| 5,679,377 A | 10/1997 | Bernstein et al. |
| 5,693,762 A | 12/1997 | Queen et al. |
| 5,698,426 A | 12/1997 | Huse |
| 5,714,350 A | 2/1998 | Co et al. |
| 5,714,352 A | 2/1998 | Jakobovits |
| 5,723,323 A | 3/1998 | Kauffman et al. |
| 5,733,743 A | 3/1998 | Johnson et al. |
| 5,736,137 A | 4/1998 | Anderson et al. |
| 5,750,753 A | 5/1998 | Kimae et al. |
| 5,763,192 A | 6/1998 | Kauffman et al. |
| 5,766,886 A | 6/1998 | Studnicka et al. |
| 5,776,456 A | 7/1998 | Anderson et al. |
| 5,780,225 A | 7/1998 | Wigler et al. |
| 5,789,554 A | 8/1998 | Leung et al. |
| 5,795,965 A | 8/1998 | Tsuchiya et al. |
| 5,814,476 A | 9/1998 | Kauffman et al. |
| 5,817,483 A | 10/1998 | Kauffman et al. |
| 5,821,047 A | 10/1998 | Garrard et al. |
| 5,824,514 A | 10/1998 | Kauffman et al. |
| 5,846,765 A | 12/1998 | Matthews et al. |
| 5,849,500 A | 12/1998 | Breitling et al. |
| 5,855,913 A | 1/1999 | Hanes et al. |
| 5,863,765 A | 1/1999 | Berry et al. |
| 5,874,064 A | 2/1999 | Edwards et al. |
| 5,891,996 A | 4/1999 | Mateo de Acosta del Rio et al. |
| 5,912,015 A | 6/1999 | Bernstein et al. |
| 5,916,597 A | 6/1999 | Lee et al. |
| 5,916,771 A | 6/1999 | Hori et al. |
| 5,929,212 A | 7/1999 | Jolliffe et al. |
| 5,934,272 A | 8/1999 | Lloyd et al. |
| 5,939,598 A | 8/1999 | Kucherlapati et al. |
| 5,959,083 A | 9/1999 | Bosslet et al. |
| 5,969,108 A | 10/1999 | McCafferty et al. |
| 5,976,862 A | 11/1999 | Kauffman et al. |
| 5,985,309 A | 11/1999 | Edwards et al. |
| 5,985,320 A | 11/1999 | Edwards et al. |
| 5,985,588 A | 11/1999 | Breitling et al. |
| 5,985,615 A | 11/1999 | Jakobovits et al. |
| 5,989,463 A | 11/1999 | Tracy et al. |
| 5,989,830 A | 11/1999 | Davis et al. |
| 5,998,209 A | 12/1999 | Jokobovits et al. |
| 6,019,968 A | 2/2000 | Platz et al. |
| 6,054,297 A | 4/2000 | Carter et al. |
| 6,057,098 A | 5/2000 | Buechler et al. |
| 6,066,719 A | 5/2000 | Zapata |
| 6,075,181 A | 6/2000 | Kucherlapati et al. |
| 6,090,382 A | 7/2000 | Salfeld et al. |
| 6,091,001 A | 7/2000 | Jakobovits et al. |
| 6,114,598 A | 9/2000 | Kucherlapati et al. |
| 6,127,132 A | 10/2000 | Breitling et al. |
| 6,130,364 A | 10/2000 | Jakobovits et al. |
| 6,180,370 B1 | 1/2001 | Queen et al. |
| 6,204,023 B1 | 3/2001 | Robinson et al. |
| 6,214,984 B1 | 4/2001 | Zapata |
| 6,235,883 B1 | 5/2001 | Jakobovits et al. |
| 6,239,259 B1 | 5/2001 | Davis et al. |
| 6,258,562 B1 | 7/2001 | Salfeld et al. |
| 6,350,861 B1 | 2/2002 | Co et al. |
| 6,387,627 B1 | 5/2002 | Breitling et al. |
| 6,491,916 B1 | 12/2002 | Bluestone et al. |
| 6,506,883 B2 | 1/2003 | Meteo de Acosta del Rio et al. |
| 6,509,015 B1 | 1/2003 | Salfeld et al. |
| 6,639,055 B1 | 10/2003 | Carter et al. |
| 6,660,843 B1 | 12/2003 | Feige et al. |
| 6,699,473 B2 | 3/2004 | Raisch et al. |
| 6,699,658 B1 | 3/2004 | Wittrup et al. |
| 6,730,483 B2 | 5/2004 | Breitling et al. |
| 6,818,392 B2 | 11/2004 | Lou et al. |
| 6,884,879 B1 | 4/2005 | Baca et al. |
| 6,914,128 B1 | 7/2005 | Salfeld et al. |
| 6,986,890 B1 | 1/2006 | Shitara et al. |
| 7,060,269 B1 | 6/2006 | Baca et al. |
| 7,060,808 B1 | 6/2006 | Goldstein et al. |
| 7,070,775 B2 | 7/2006 | Le et al. |
| 7,179,892 B2 | 2/2007 | Basi et al. |
| 7,189,819 B2 | 3/2007 | Basi et al. |
| 7,202,343 B2 | 4/2007 | Gudas et al. |
| 7,247,301 B2 | 7/2007 | van de Winkel et al. |
| 7,247,304 B2 | 7/2007 | van de Winkel et al. |
| 7,258,857 B2 | 8/2007 | Stern et al. |
| 7,262,028 B2 | 8/2007 | Van Berkel et al. |
| 7,285,269 B2 | 10/2007 | Babcook et al. |
| 7,317,091 B2 | 1/2008 | Lazar et al. |
| 7,419,821 B2 | 9/2008 | Davis et al. |
| 7,429,486 B2 | 9/2008 | Van Berkel et al. |
| 7,438,911 B2 | 10/2008 | Shitara et al. |
| 7,446,175 B2 | 11/2008 | Gram et al. |
| 7,446,179 B2 | 11/2008 | Jensen et al. |
| 7,449,616 B2 | 11/2008 | Pons et al. |
| 7,491,516 B2 | 2/2009 | Collinson et al. |
| 7,528,236 B2 | 5/2009 | Fong et al. |
| 7,566,772 B2 | 7/2009 | Green et al. |
| 7,592,429 B2 | 9/2009 | Paszty et al. |
| 7,612,181 B2 | 11/2009 | Wu et al. |
| 7,682,833 B2 | 3/2010 | Miller et al. |
| 7,727,527 B2 | 6/2010 | Shelton |
| 7,790,858 B2 | 9/2010 | Presta |
| 7,863,419 B2 | 1/2011 | Taylor et al. |
| 7,928,205 B2 | 4/2011 | Dillon et al. |
| 8,187,836 B2 | 5/2012 | Hsieh |
| 8,258,268 B2 | 9/2012 | Wu et al. |
| 8,388,965 B2 | 3/2013 | Rao et al. |
| 8,389,237 B2 | 3/2013 | Skerry et al. |
| 8,420,783 B2 | 4/2013 | Goldenberg et al. |
| 8,455,219 B2 | 6/2013 | Hsieh |
| 8,586,714 B2 | 11/2013 | Ghayur et al. |
| 8,623,358 B2 | 1/2014 | Benatuil et al. |
| 8,624,002 B2 | 1/2014 | Gu et al. |
| 8,664,367 B2 | 3/2014 | Wu et al. |
| 8,716,450 B2 | 5/2014 | Ghayur et al. |
| 8,722,855 B2 | 5/2014 | Ghayur et al. |
| 8,735,546 B2 | 5/2014 | Ghayur et al. |
| 8,779,101 B2 | 7/2014 | Hsieh et al. |
| 8,822,645 B2 | 9/2014 | Ghayur et al. |
| 8,835,610 B2 | 9/2014 | Hsieh et al. |
| 8,841,417 B2 | 9/2014 | Wu et al. |
| 8,853,365 B2 | 10/2014 | Wu et al. |
| 8,858,941 B2 | 10/2014 | Gurney et al. |
| 8,889,130 B2 | 11/2014 | Kamath |
| 8,987,418 B2 | 3/2015 | Ghayur et al. |
| 9,029,508 B2 | 5/2015 | Ghayur et al. |
| 9,035,027 B2 | 5/2015 | Ghayur et al. |
| 9,045,551 B2 | 6/2015 | Gu et al. |
| 9,046,513 B2 | 6/2015 | Ghayur et al. |
| 9,062,108 B2 | 6/2015 | Ghayur et al. |
| 9,109,026 B2 | 8/2015 | Ghayur et al. |
| 9,115,195 B2 | 8/2015 | Chen et al. |
| 9,120,870 B2 | 9/2015 | Hsieh et al. |
| 9,132,190 B2 | 9/2015 | Benatuil et al. |
| 2002/0004587 A1 | 1/2002 | Miller et al. |
| 2002/0127231 A1 | 9/2002 | Schneck et al. |
| 2002/0136719 A1 | 9/2002 | Shenoy et al. |
| 2002/0137134 A1 | 9/2002 | Gerngross |
| 2003/0039645 A1 | 2/2003 | Adair et al. |
| 2003/0091561 A1 | 5/2003 | van de Winkel et al. |
| 2003/0092059 A1 | 5/2003 | Salfeld et al. |
| 2003/0118583 A1 | 6/2003 | Emery et al. |
| 2003/0165496 A1 | 9/2003 | Basi et al. |
| 2003/0186374 A1 | 10/2003 | Hufton et al. |
| 2003/0206898 A1 | 11/2003 | Fischkoff et al. |
| 2003/0226155 A1 | 12/2003 | Sadeghi et al. |
| 2004/0018577 A1 | 1/2004 | Emerson Campbell et al. |
| 2004/0018590 A1 | 1/2004 | Gerngross et al. |
| 2004/0038339 A1 | 2/2004 | Kufer et al. |
| 2004/0133357 A1 | 7/2004 | Zhong et al. |
| 2004/0162411 A1 | 8/2004 | Lanzavecchia |
| 2004/0219144 A1 | 11/2004 | Shelton |
| 2004/0237124 A1 | 11/2004 | Pons et al. |
| 2004/0241745 A1 | 12/2004 | Honjo et al. |
| 2005/0026881 A1 | 2/2005 | Robinson et al. |
| 2005/0038231 A1 | 2/2005 | Fahrner et al. |
| 2005/0042664 A1 | 2/2005 | Wu et al. |
| 2005/0095246 A1 | 5/2005 | Shafer |
| 2005/0118643 A1 | 6/2005 | Burgess et al. |

(56) References Cited

U.S. PATENT DOCUMENTS

| | | |
|---|---|---|
| 2005/0147610 A1 | 7/2005 | Ghayur et al. |
| 2005/0215769 A1 | 9/2005 | Breece et al. |
| 2005/0260204 A1 | 11/2005 | Allan |
| 2006/0002923 A1 | 1/2006 | Uede et al. |
| 2006/0024300 A1 | 2/2006 | Adams et al. |
| 2006/0041058 A1 | 2/2006 | Yin et al. |
| 2006/0067930 A1 | 3/2006 | Adams et al. |
| 2006/0073141 A1 | 4/2006 | Ignatovich et al. |
| 2006/0078967 A1 | 4/2006 | Medlock et al. |
| 2006/0093599 A1 | 5/2006 | Gazit-Bornstein et al. |
| 2006/0104968 A1 | 5/2006 | Bookbinder et al. |
| 2006/0134105 A1 | 6/2006 | Lazar et al. |
| 2006/0160164 A1 | 7/2006 | Miller et al. |
| 2006/0233791 A1 | 10/2006 | Tedder et al. |
| 2006/0246071 A1 | 11/2006 | Green et al. |
| 2006/0253100 A1 | 11/2006 | Burright et al. |
| 2006/0280747 A1 | 12/2006 | Fuh et al. |
| 2007/0041905 A1 | 2/2007 | Hoffman et al. |
| 2007/0042458 A1 | 2/2007 | DeFrees et al. |
| 2007/0071675 A1 | 3/2007 | Wu et al. |
| 2007/0071745 A1 | 3/2007 | Umana et al. |
| 2007/0072225 A1 | 3/2007 | Alving |
| 2007/0092507 A1 | 4/2007 | Balthasar et al. |
| 2007/0092520 A1 | 4/2007 | Dennis et al. |
| 2007/0110747 A1 | 5/2007 | Paszty et al. |
| 2007/0123479 A1 | 5/2007 | Kufer et al. |
| 2007/0196376 A1 | 8/2007 | Raeber et al. |
| 2007/0232556 A1 | 10/2007 | Montine et al. |
| 2007/0286858 A1 | 12/2007 | Clancy et al. |
| 2007/0292420 A1 | 12/2007 | Giles-Komar et al. |
| 2008/0014196 A1 | 1/2008 | Yan |
| 2008/0015194 A1 | 1/2008 | Errico et al. |
| 2008/0038257 A1 | 2/2008 | Han et al. |
| 2008/0112888 A1 | 5/2008 | Wang |
| 2008/0118506 A1 | 5/2008 | An et al. |
| 2008/0118978 A1 | 5/2008 | Sato et al. |
| 2008/0171014 A1 | 7/2008 | Wu et al. |
| 2008/0175847 A1 | 7/2008 | Yan et al. |
| 2008/0187966 A1 | 8/2008 | Simmons |
| 2008/0193455 A1 | 8/2008 | Stassen et al. |
| 2008/0219971 A1 | 9/2008 | Smith et al. |
| 2008/0241163 A1 | 10/2008 | Burkly et al. |
| 2009/0028851 A1 | 1/2009 | Stuhmer et al. |
| 2009/0030308 A1 | 1/2009 | Bradford et al. |
| 2009/0035308 A1 | 2/2009 | Gill et al. |
| 2009/0042214 A1 | 2/2009 | Cooke et al. |
| 2009/0048122 A1 | 2/2009 | Glaser et al. |
| 2009/0053243 A1 | 2/2009 | Kurosawa et al. |
| 2009/0068195 A1 | 3/2009 | Vugmeyster et al. |
| 2009/0081234 A1 | 3/2009 | Heavner et al. |
| 2009/0148513 A1 | 6/2009 | Fraunhofer et al. |
| 2009/0155257 A1 | 6/2009 | Adams et al. |
| 2009/0155275 A1 | 6/2009 | Wu et al. |
| 2009/0191225 A1 | 7/2009 | Chang et al. |
| 2009/0208490 A1 | 8/2009 | Pavone et al. |
| 2009/0215992 A1 | 8/2009 | Wu et al. |
| 2009/0239259 A1 | 9/2009 | Hsieh |
| 2009/0259026 A1 | 10/2009 | Tomlinson et al. |
| 2009/0304693 A1 | 12/2009 | Ghayur et al. |
| 2009/0311253 A1 | 12/2009 | Ghayur et al. |
| 2010/0028340 A1 | 2/2010 | Mueller et al. |
| 2010/0040537 A1 | 2/2010 | Gu et al. |
| 2010/0047239 A1 | 2/2010 | Wu et al. |
| 2010/0056762 A1 | 3/2010 | Old |
| 2010/0074900 A1 | 3/2010 | Ghayur et al. |
| 2010/0076178 A1 | 3/2010 | Ghayur et al. |
| 2010/0104573 A1 | 4/2010 | Burkly et al. |
| 2010/0105569 A1 | 4/2010 | Hsieh et al. |
| 2010/0158901 A1 | 6/2010 | Tedder et al. |
| 2010/0190247 A1 | 7/2010 | Lazar et al. |
| 2010/0233079 A1 | 9/2010 | Jakob et al. |
| 2010/0260668 A1 | 10/2010 | Ghayur et al. |
| 2010/0266531 A1 | 10/2010 | Hsieh et al. |
| 2011/0008766 A1 | 1/2011 | Ghayur et al. |
| 2011/0044980 A1 | 2/2011 | Ghayur et al. |
| 2011/0091463 A1 | 4/2011 | Ghayur et al. |
| 2011/0142761 A1 | 6/2011 | Wu et al. |
| 2011/0150870 A1 | 6/2011 | Rader et al. |
| 2011/0212094 A1 | 9/2011 | Ghayur et al. |
| 2011/0217237 A1 | 9/2011 | Chen et al. |
| 2011/0229476 A1 | 9/2011 | Liu et al. |
| 2011/0263827 A1 | 10/2011 | Ghayur et al. |
| 2011/0318349 A1 | 12/2011 | Ghayur et al. |
| 2012/0014957 A1 | 1/2012 | Ghayur et al. |
| 2012/0034160 A1 | 2/2012 | Ghayur et al. |
| 2012/0087858 A1 | 4/2012 | Ghayur et al. |
| 2012/0201746 A1 | 8/2012 | Liu et al. |
| 2012/0258108 A1 | 10/2012 | Ghayur et al. |
| 2012/0263722 A1 | 10/2012 | Ghayur et al. |
| 2013/0004416 A1 | 1/2013 | Wu et al. |
| 2013/0164256 A1 | 6/2013 | Hsieh et al. |
| 2013/0171059 A1 | 7/2013 | Ghayur et al. |
| 2013/0171096 A1 | 7/2013 | Hsieh et al. |
| 2013/0195871 A1 | 8/2013 | Ghayur et al. |
| 2013/0236458 A1 | 9/2013 | Hsieh et al. |
| 2013/0344537 A1 | 12/2013 | Hsieh |
| 2014/0079705 A1 | 3/2014 | Hsieh et al. |
| 2014/0093521 A1 | 4/2014 | Benatuil et al. |
| 2014/0099671 A1 | 4/2014 | Wu et al. |
| 2014/0134171 A1 | 5/2014 | Ghayur et al. |
| 2014/0134172 A1 | 5/2014 | Gu et al. |
| 2014/0161804 A1 | 6/2014 | Cuff et al. |
| 2014/0161817 A1 | 6/2014 | Siedler et al. |
| 2014/0170152 A1 | 6/2014 | Hsieh et al. |
| 2014/0186377 A1 | 7/2014 | Gu et al. |
| 2014/0205562 A1 | 7/2014 | Wu et al. |
| 2014/0212379 A1 | 7/2014 | Wu et al. |
| 2014/0212423 A1 | 7/2014 | Hanzatian et al. |
| 2014/0212925 A1 | 7/2014 | Wu et al. |
| 2014/0213771 A1 | 7/2014 | Ghayur et al. |
| 2014/0213772 A1 | 7/2014 | Ghayur et al. |
| 2014/0219912 A1 | 8/2014 | Ghayur et al. |
| 2014/0219913 A1 | 8/2014 | Ghayur et al. |
| 2014/0220019 A1 | 8/2014 | Ghayur et al. |
| 2014/0220020 A1 | 8/2014 | Wu et al. |
| 2014/0221621 A1 | 8/2014 | Benatuil et al. |
| 2014/0221622 A1 | 8/2014 | Ghayur et al. |
| 2014/0235476 A1 | 8/2014 | Gu et al. |
| 2014/0243228 A1 | 8/2014 | Benatuil et al. |
| 2014/0271457 A1 | 9/2014 | Ghayur et al. |
| 2014/0271458 A1 | 9/2014 | Ghayur et al. |
| 2014/0308286 A1 | 10/2014 | Ghayur et al. |
| 2014/0335014 A1 | 11/2014 | Ghayur et al. |
| 2014/0335564 A1 | 11/2014 | Hsieh et al. |
| 2014/0343267 A1 | 11/2014 | Hsieh et al. |
| 2014/0348834 A1 | 11/2014 | Hsieh et al. |
| 2014/0348835 A1 | 11/2014 | Gu et al. |
| 2014/0348838 A1 | 11/2014 | Tarcsa |
| 2014/0348856 A1 | 11/2014 | Hsieh et al. |
| 2014/0356281 A1 | 12/2014 | Ghayur et al. |
| 2014/0356909 A1 | 12/2014 | Hsieh et al. |
| 2015/0017095 A1 | 1/2015 | Ghayur et al. |
| 2015/0017168 A1 | 1/2015 | Ghayur et al. |
| 2015/0050238 A1 | 2/2015 | Kamath |
| 2015/0104452 A1 | 4/2015 | Ghayur et al. |
| 2015/0183867 A1 | 7/2015 | Ghayur et al. |
| 2015/0291689 A1 | 10/2015 | Padley et al. |
| 2015/0315283 A1 | 11/2015 | Ghayur et al. |
| 2015/0344566 A1 | 12/2015 | Hsieh et al. |
| 2015/0344590 A1 | 12/2015 | Ghayur et al. |
| 2016/0002343 A1 | 1/2016 | Hanzatian et al. |
| 2016/0031986 A1 | 2/2016 | Chen et al. |
| 2016/0032000 A1 | 2/2016 | Ghayur et al. |

FOREIGN PATENT DOCUMENTS

| | | |
|---|---|---|
| EP | 0 148 075 A2 | 7/1985 |
| EP | 0 517 024 A2 | 12/1992 |
| EP | 0 592 106 A1 | 4/1994 |
| EP | 0 239 400 B1 | 8/1994 |
| EP | 1 176 195 A1 | 1/2002 |
| EP | 1 454 917 A2 | 9/2004 |
| EP | 0 592 106 B1 | 11/2004 |
| EP | 0 519 596 B1 | 2/2005 |

(56) References Cited

FOREIGN PATENT DOCUMENTS

| | | |
|---|---|---|
| RU | 2 273 664 C2 | 4/2006 |
| WO | WO 89/06692 A1 | 7/1989 |
| WO | WO 90/02809 A1 | 3/1990 |
| WO | WO 90/05144 A1 | 5/1990 |
| WO | WO 90/05183 A1 | 5/1990 |
| WO | WO 90/14424 A1 | 11/1990 |
| WO | WO 90/14430 A1 | 11/1990 |
| WO | WO 90/14443 A1 | 11/1990 |
| WO | WO 91/05548 A1 | 5/1991 |
| WO | WO 91/09967 A1 | 7/1991 |
| WO | WO 91/10737 A1 | 7/1991 |
| WO | WO 91/10741 A1 | 7/1991 |
| WO | WO 91/17271 A1 | 11/1991 |
| WO | WO 91/18983 A1 | 12/1991 |
| WO | WO 92/01047 A1 | 1/1992 |
| WO | WO 92/02551 A1 | 2/1992 |
| WO | WO 92/03461 A1 | 3/1992 |
| WO | WO 92/09690 A2 | 6/1992 |
| WO | WO 92/11272 A1 | 7/1992 |
| WO | Wo 92/15679 A1 | 9/1992 |
| WO | WO 92/16553 A1 | 10/1992 |
| WO | WO 92/18619 A1 | 10/1992 |
| WO | WO 92/19244 A2 | 11/1992 |
| WO | WO 92/20791 A1 | 11/1992 |
| WO | WO 92/22324 A1 | 12/1992 |
| WO | WO 92/22653 A1 | 12/1992 |
| WO | WO 93/01288 A1 | 1/1993 |
| WO | WO 93/06213 A1 | 4/1993 |
| WO | WO 93/11161 A1 | 6/1993 |
| WO | WO 93/11236 A1 | 6/1993 |
| WO | WO 94/02602 A1 | 2/1994 |
| WO | WO 94/11026 A1 | 5/1994 |
| WO | WO 94/18219 A1 | 8/1994 |
| WO | WO 95/01997 a1 | 1/1995 |
| WO | WO 95/09917 A1 | 4/1995 |
| WO | WO 95/14780 A2 | 6/1995 |
| WO | WO 95/15982 A2 | 6/1995 |
| WO | WO 95/16026 | 6/1995 |
| WO | WO 95/20045 A1 | 7/1995 |
| WO | WO 95/20401 A1 | 8/1995 |
| WO | WO 95/24918 A1 | 9/1995 |
| WO | WO 95/25167 A1 | 9/1995 |
| WO | WO 96/20698 A2 | 7/1996 |
| WO | WO 96/33735 A1 | 10/1996 |
| WO | WO 96/34096 A1 | 10/1996 |
| WO | WO 96/40210 A1 | 12/1996 |
| WO | WO 97/20032 A1 | 6/1997 |
| WO | WO 97/29131 A1 | 8/1997 |
| WO | WO 97/32572 A2 | 9/1997 |
| WO | WO 97/44013 A1 | 11/1997 |
| WO | WO 98/16654 A1 | 4/1998 |
| WO | WO 98/24893 A2 | 6/1998 |
| WO | WO 98/31346 A1 | 7/1998 |
| WO | WO 98/31700 A1 | 7/1998 |
| WO | WO 98/45331 A2 | 10/1998 |
| WO | WO 98/50433 A2 | 11/1998 |
| WO | WO 99/06834 A2 | 2/1999 |
| WO | WO 99/15154 A1 | 4/1999 |
| WO | WO 99/20253 A1 | 4/1999 |
| WO | WO 99/23221 A2 | 5/1999 |
| WO | WO 99/45031 A2 | 9/1999 |
| WO | WO 99/53049 A1 | 10/1999 |
| WO | WO 99/54342 A1 | 10/1999 |
| WO | WO 99/57134 A1 | 11/1999 |
| WO | WO 99/66903 A2 | 12/1999 |
| WO | WO 00/06560 A2 | 2/2000 |
| WO | WO 00/37504 A2 | 6/2000 |
| WO | WO 00/56772 A1 | 9/2000 |
| WO | WO 00/78815 A1 | 12/2000 |
| WO | WO 01/00244 A2 | 1/2001 |
| WO | WO 01/32712 A2 | 5/2001 |
| WO | WO 01/58956 A2 | 8/2001 |
| WO | WO 01/62300 A2 | 8/2001 |
| WO | WO 01/62931 A2 | 8/2001 |
| WO | WO 01/71005 A2 | 9/2001 |
| WO | WO 01/77342 A1 | 10/2001 |
| WO | WO 01/83525 A2 | 11/2001 |
| WO | WO 01/88138 A1 | 11/2001 |
| WO | WO 02/02773 A2 | 1/2002 |
| WO | WO 02/02781 A1 | 1/2002 |
| WO | WO 02/12502 A2 | 2/2002 |
| WO | WO 02/16436 A2 | 2/2002 |
| WO | WO 02/053596 A2 | 7/2002 |
| WO | WO 02/072636 A2 | 9/2002 |
| WO | WO 02/097048 A2 | 12/2002 |
| WO | WO 03/016466 A2 | 2/2003 |
| WO | WO 03/035835 A2 | 5/2003 |
| WO | WO 03/039486 A2 | 5/2003 |
| WO | WO 03/068801 A2 | 8/2003 |
| WO | WO 03/086458 A1 | 10/2003 |
| WO | WO 03/089614 A2 | 10/2003 |
| WO | WO 03/100008 A2 | 12/2003 |
| WO | WP 03/102132 A2 | 12/2003 |
| WO | WO 2004/003019 A2 | 1/2004 |
| WO | WO 2004/016286 A2 | 2/2004 |
| WO | WO 2004/024866 A2 | 3/2004 |
| WO | WO 2004/050683 A2 | 6/2004 |
| WO | WO 2004/058184 A2 | 7/2004 |
| WO | WP 2004/078140 A2 | 9/2004 |
| WO | WO 2005/016970 A2 | 2/2005 |
| WO | WO 2005/017107 A2 | 2/2005 |
| WO | WO 2005/044853 A2 | 5/2005 |
| WO | WO 2005/061540 A2 | 7/2005 |
| WO | WO 2005/061547 A2 | 7/2005 |
| WO | WO 2005/100584 A2 | 10/2005 |
| WO | WO 2005/118635 A2 | 12/2005 |
| WO | WO 2005/120557 A2 | 12/2005 |
| WO | WO 2006/001965 A2 | 1/2006 |
| WO | WO 2006/013107 A1 | 2/2006 |
| WO | WO 2006/015373 A2 | 2/2006 |
| WO | WO 2006/020258 A2 | 2/2006 |
| WO | WO 2006/024867 A2 | 3/2006 |
| WO | WO 2006/031370 A2 | 3/2006 |
| WO | WO 2006/044908 A2 | 4/2006 |
| WO | WO 2006/047350 A2 | 5/2006 |
| WO | WO 2006/066171 A1 | 6/2006 |
| WO | WO 2006/089133 A2 | 8/2006 |
| WO | WO 2006/099698 A2 | 9/2006 |
| WO | WO 2006/110883 A2 | 10/2006 |
| WO | WO 2006/116269 A2 | 11/2006 |
| WO | WO 2006/122187 A2 | 11/2006 |
| WO | WO 2006/130374 A2 | 12/2006 |
| WO | WO 2006/130429 A2 | 12/2006 |
| WO | WO 2006/131951 A2 | 12/2006 |
| WO | WO 2006/136159 A2 | 12/2006 |
| WO | WO 2007/005955 A2 | 1/2007 |
| WO | WO 2007/024715 A9 | 3/2007 |
| WO | WO 2007/042261 A2 | 4/2007 |
| WO | WO 2007/046849 A1 | 5/2007 |
| WO | WO 2007/053447 A2 | 5/2007 |
| WO | WO 2007/056470 A2 | 5/2007 |
| WO | WO 2007/059136 A2 | 5/2007 |
| WO | WO 2007/062037 A2 | 5/2007 |
| WO | WO 2007/062852 A2 | 6/2007 |
| WO | WO 2007/077026 A2 | 7/2007 |
| WO | WO 2007/098417 A1 | 8/2007 |
| WO | WO 2007/117749 A2 | 10/2007 |
| WO | WO 2007/120651 A2 | 10/2007 |
| WO | WO 2007/120828 A1 | 10/2007 |
| WO | WO 2007/124299 A2 | 11/2007 |
| WO | WO 2007/143098 A2 | 12/2007 |
| WO | WO 2007/147901 A1 | 12/2007 |
| WO | WO 2008/011348 A2 | 1/2008 |
| WO | WO 2008/022152 A2 | 2/2008 |
| WO | WO 2008/024188 A2 | 2/2008 |
| WO | WO 2008/042236 A2 | 4/2008 |
| WO | WO 2008/057240 A2 | 5/2008 |
| WO | WO 2008/079326 A2 | 7/2008 |
| WO | WO 2008/100624 A2 | 8/2008 |
| WO | WO 2008/145338 A2 | 12/2008 |
| WO | WO 2008/150841 A1 | 12/2008 |
| WO | WO 2009/020654 A1 | 2/2009 |
| WO | WO 2009/052400 A1 | 4/2009 |
| WO | WO 2009/077993 A2 | 6/2009 |

(56) References Cited

FOREIGN PATENT DOCUMENTS

| | | |
|---|---|---|
| WO | WO 2009/089004 A1 | 7/2009 |
| WO | WO 2009/091912 A2 | 7/2009 |
| WO | WO 2009/134776 A2 | 11/2009 |
| WO | WO 2009/136382 A2 | 11/2009 |
| WO | WO 2009/149185 A2 | 12/2009 |
| WO | WO 2009/149189 A2 | 12/2009 |
| WO | WO 2009/155324 A2 | 12/2009 |
| WO | WO 2010/006060 A2 | 1/2010 |
| WO | WO 2010/040508 A8 | 4/2010 |
| WO | WO 2010/065882 A1 | 6/2010 |
| WO | WO 2010/096434 A2 | 8/2010 |
| WO | WO 2010/102251 A2 | 9/2010 |
| WO | WO 2010/127284 A2 | 11/2010 |
| WO | WO 2011/014659 A2 | 2/2011 |
| WO | WO 2011/028811 A2 | 3/2011 |
| WO | WO 2011/039370 A1 | 4/2011 |
| WO | WO 2011/059755 A2 | 5/2011 |
| WO | WO 2011/084714 A2 | 7/2011 |
| WO | WO 2011/091304 A1 | 7/2011 |
| WO | WO 2011/143562 A2 | 11/2011 |
| WO | WO 2012/061374 A2 | 5/2012 |
| WO | WO 2012/075037 A1 | 6/2012 |
| WO | WO 2012/088302 A2 | 6/2012 |
| WO | WO 2012/143379 A1 | 10/2012 |
| WO | WO 2013/177062 A2 | 1/2013 |
| WO | WO 2013/112922 A1 | 8/2013 |
| WO | WO 2014/033074 A2 | 3/2014 |
| WO | WO 2014/089209 A2 | 6/2014 |
| WO | WO 2015/014884 A1 | 2/2015 |

OTHER PUBLICATIONS

Cooper et al., "Variable domain-identical antibodies exhibit IgG subclass-related differences in affinity and kinetic constants as determined by surface plasmon resonance," *Mol. Immunol.*, 31(8): 577-584 (Jun. 1994).
European Patent Application No. 11838670.5: Partial Supplementary European Search Report, dated Jun. 24, 2015 (10 pages).
European Patent Application No. 15153941.8 by AbbVie Inc.: Extended European Search Report and Opinion, dated Jun. 10, 2015 (8 pages).
European Patent Application No. 15162013.5 by AbbVie Inc.: Partial European Search Report, dated Jul. 17, 2015 (8 pages).
Garber, K., "Targeting vessel abnormalization in cancer," *J. Natl. Canc. Inst.*, 99(13): 991-995 (2007).
Hezareh et al., "Effector Function Activities of a Panel of Mutants of a Broadly Neutralizing Antibody against Human Immunodeficiency Virus Type 1," *J. Virol.*, 75(24): 12161-12168 (Dec. 2001).
Inter Partes Reexamination (Control No. 95/001,380) of U.S. Pat. No. 7,612,181 (U.S. Appl. No. 11/507,050): Requester Comments on Patent Owner Response after Board Decision ("Sanofi's Comments Pursuant to 37 C.F.R. § 41.77(e)"), dated Aug. 2, 2015.
Lajoie, S. et al., "Complement-mediated regulation of the IL-17A axis is a central genetic determinant of the severity of experimental allergic asthma," *Nat. Immunol.*, 11(10): 928-935 (Oct. 2010).
Ridgway et al., "Inhibition of Dll4 signalling inhibits tumour growth by deregulating angiogenesis," *Nature*, 144(7122): 1083-1087 (2006).
Romon et al., "Nerve growth factor promotes breast cancer angiogenesis by activating multiple pathways," *Mol. Cancer*, [online] 9:157 (13 pages) (Jun. 2010). Retrieved from the Internet: http://rd.springer.com/content/pdf/10.1186/1476-4598-9-157.pdf; retrieved on Jul. 1, 2015.
Thurston et al., "The Delta paradox: DLL4 blockade leads to more tumour vessels but less tumour growth," *Nat. Rev.: Cancer*, 7(5): 327-331 (2007).
Torres et al., "The Immunoglobulin Heavy Chain Constant Region Affects Kinetic and Thermodynamic Parameters of Antibody Variable Region Interactions with Antigen," *J. Biol. Chem.*, 282(18): 13917-13927 (May 2007).

U.S. Appl. No. 13/729,353, filed Dec. 28, 2012 by Ghayur et al.: Non-Final Office Action, Jun. 2, 2015.
U.S. Appl. No. 14/301,546, filed Jun. 11, 2014 by Gu et al.: Non-Final Office Action, Nov. 25, 2014.
U.S. Appl. No. 14/323,627, filed Jul. 3, 2014 by Ghayur et al.: Notice of Allowance, Dec. 8, 2014.
Wang, P. and X. Yang, "Neutralization Efficiency is Greatly Enhanced by Bivalent Binding of an Antibody to Epitopes in the V4 Region and the Membrane-Proximal External Region within One Trimer of Human Immunodeficiency Virus Type 1 Glycoproteins" *J. Virol.*, 84(14): 7114-7123 (2010).
Wynn et al., "Distinct roles for IL-13 and IL-17 in chronic inflammation and fibrosis," *J. Immunol.*, 184:134.8 (2010).
Arimura et al., "Prevention of Allergic Inflammation by a Novel Prostaglandin Receptor Antagonist, S-5751," *J. Pharmacol. Exper. Therapeut.*, 298(2): 411-419 (2001).
Aroonrerk et al., "A sensitive direct ELISA for detection of prostaglandin E2," *J. Immunoassay & Immunochem.*, 28:319-330 (2007).
Ayoub et al., "Preferential Formation of MT1/MT2 Melatonin Receptor Heterodimers with Distinct Ligand Interactin Properties Comapred with MT2 Homodimers," *Mol. Pharmacol.*, 66(2): 312-321 (2004).
Boado et al., "Fusion Antibody for Alzheimer's Disease with Bidirectional Transport Across the Blood-Brain Barrier and Aβ Fibril Disaggregation," *Bioconj. Chem.*, 18(2): 447-455 (2007).
Caron et al., "Chondroprotective Effect of Intraarticular Injections of Interleukin-1 Receptor Antagonist in Experimental Osteoarthritis," *Arthritis Rheum.*, 39: 1535-1544 (1996).
Dahesia et al., "The Interleukin 1β Pathway in the Pathogenesis of Osteoarthritis," *J. Rheumatol.* 35(12): 2306-2312 (2008).
Dayer et al., "Collagenase Production by Rheumatoid Synovial Cells: Stimulation by a Human Lymphocyte Factor," *Science*, 195: 181-183 (1977).
Dayer et al., "Effects of Prostaglandin E2, Indomethacin, Trifluoperazine and Drugs Affecting the Cytoskeleton on Collagenase Production by Cultured Adherent Rheumatoid Synovial Cells," *Biochem. Pharmacol.*, 33(18): 2893-2899 (1984).
Dinarello et al., "Immunological and Inflammatory Functions of the Interleukin-1 Family," *Annu. Rev. Immunol.*, 27: 519-550 (2009).
European Patent Application No. 06813554.0: Written Submission in Preparation to Oral Proceedings, dated Jan. 23, 2015 (100 pages).
European Patent Application No. 06813554.0: Minutes of Oral Proceedings, dated Jan. 29, 2015 (7 pages).
European Patent Application No. 06813554.0: Reply to Minutes of Oral Proceedings, dated Jan. 29, 2015 (1 page).
European Patent Application No. 10814433.8: Supplementary European Search Report and Search Opinion, dated Apr. 18, 2013 (11 pages).
European Patent Application No. 10825739.5: Supplementary European Search Report and Search Opinion, dated Apr. 29, 2013 (13 pages).
European Patent Application No. 10830460.1: Supplementary European Search Report and Search Opinion, dated Apr. 29, 2013 (15 pages).
European Patent Application No. 11815172.9: Partial Supplementary European Search Report, dated Nov. 12, 2014 (10 pages).
European Patent Application No. 11815172.9: Supplementary European Search Report and Search Opinion, dated Jan. 21, 2015 (16 pages).
European Patent Application No. 14176206.2 by AbbVie Inc.: Extended European Search Report and Opinion, dated Nov. 12, 2014 (7 pages).
Fernandes et al., "In Vivo Transfer of Interleukin-1 Receptor Antagonist Gene in Osteoarthritic Rabbit Knee Joints," *Am. J. Pathol.*, 154(4): 1159-1169 (1999).
Flierl et al., "Adverse functions of IL-17A in experimental sepsis," *FASEB J.*, 22: 2198-2205 (2008).
Garber, K, "Anti-IL-17 mAbs herald new options in psoriasis," *Nat. Biotechnol.*, 30(6): 475-477 (2012).
GenBank Accession No. BAL50004, "Anti-prostaglandin E2 antibody kappa light chain [Mus musculus]," Feb. 4, 2012 (2 pages).

(56) References Cited

OTHER PUBLICATIONS

Goldring et al., "Interleukin 1 Suppresses Expression of Cartilage-specific Types II and IX Collagens and Increases Types I and III Collagens in Human Chondrocytes," *J. Clin. Investig.*, 82: 2026-2037 (1988).
Goldring et al., "Modulation by Recombinant Interleukin 1 of Synthesis of Types I and III Collagens and Associated Procollagen mRNA Levels in Cultured Human Cells," *J. Biol. Chem.*, 262: 16724-16729 (1987).
Grothey and Galanis, "Targeting angiogenesis: progress with anti-VEGF treatment with large molecules," *Nat. Rev. Clin. Oncol.*, 6:507-518 (2009).
Gu et al., "Generation of Dual-Variable-Domain Immunoglobulin Molecules for Dual-Specific Targeting," *Methods in Enzymology*, 502: 25-41 (2012).
Hart et al., "Suppression of Ongoing Disease in a Nonhuman Primate Model of Multiple Sclerosis by a Human-Anti-Human IL-12p40 Antibody," *J. Immunol.*, 175(7): 4781-4788 (2005).
Hill et al., "Interleukin-17 deficiency improves locomotor recovery and tissue sparing after spinal cord contusion injury in mice," *Neurosci. Lett.*, 487(3): 363-367 (2011).
Hindawi et al., "The development and application of a direct radioimmunoassay for prostaglandin E2 utilising a α-labelled ligand," *Prostaglandins, Leukotrienes and Medicine*, 18: 81-94 (1985).
Honegger et al., "Yet Another Numbering Scheme for Immunoglobulin Variable Domains: An Automatic Modeling and Analysis Tool," *J. Mol. Biol.*, 309(3): 657-670 (2001).
Honorati et al., "Contribution of interleukin 17 to human cartilage degredation and synovial inflammation in osteoarthritis," *Osteoarthritis and Cartilage*, 10: 799-807 (2002).
Inter Partes Reexamination (Control No. 95/001,380) of U.S. Pat. No. 7,612,181 (U.S. Appl. No. 11/507,050): Decision on Appeal, dated Mar. 24, 2014.
Inter Partes Reexamination (Control No. 95/001,380) of U.S. Pat. No. 7,612,181(U.S. Appl. No. 11/507,050): Request to Reopen Prosecution Pursuant to 37 CFR § 41,77(b)(1), dated May 23, 2014.
Inter Partes Reexamination (Control No. 95/001,380) of U.S. Pat. No. 7,612,181 (U.S. Appl. No. 11/507,050): Third Party Requester Comments on Patent Owner Response after Board Decision ("Sanofi's Comments Pursuant to 37 C.F.R. § 41.77(c)"), dated Jun. 22, 2014.
Inter Partes Reexamination (Control No. 95/001,380) of U.S. Pat. No. 7,612,181 (U.S. Appl. No. 11/507,050): Record of Oral Hearing, dated Aug. 4, 2014.
Inter Partes Reexamination (Control No. 95/001,380) of U.S. Pat. No. 7,612,181 (U.S. Appl. No. 11/507,050): Order Reopening Prosecution and Remanding Inter Partes Reexamination Under 37 C.F.R. § 41.77(d) to the Examiner, dated Nov. 20, 2014.
International Patent Application No. PCT/US2009/049953: International Search Report and Written Opinion, mailed Oct. 29, 2009 (10 pages).
International Patent Application No. PCT/US2013/067873: International Search Report and Written Opinion, dated May 8, 2014 (23 pages).
International Patent Application No. PCT/US2014/028618: Invitation to Pay Additional Fees and Communication Relating to the Results of the Partial International Search, dated Aug. 13, 2014 (8 pages).
International Patent Application No. PCT/US2014/028618: International Search Report and Written Opinion, Oct. 28, 2014 (25 pages).
International Patent Application No. PCT/US2014/028646: International Search Report and Written Opinion, Oct. 17, 2014 (18 pages).
International Patent Application No. PCT/US2014/028646: Invitation to Pay Additional Fees and Communication Relating to the Results of the Partial International Search, dated Aug. 14, 2014 (10 pages).

Jakob et al., "Structure reveals function of the dual variable domain immunoglobulin (DVD-Ig™) molecule," *mAbs*, 5(3): 358-363 (2013).
Jotanovic et al., "Role of Interleukin-1 Inhibitors in Osteoarthritis," *Drugs Aging*, 29(5): 343-358 (2012).
Kim and Moalem-Taylor, "Interleukin-17 Contributes to Neuroinflammation and Neuropathic Pain Following Peripheral Nerve Injury in Mice," *J. Pain*, 12(3): 370-383 (2010).
Kou et al., "A bispecific antibody effectively inhibits tumor growth and metastasis by simultaneous blocking vascular endothelial growth factor A and osteopontin," *Cancer Lett.*, 299: 130-136 (2010).
Kyte et al., "A Simple Method for Displaying the Hydropathic Character of a Protein," *J. Mol. Biol.*, 157: 105-132 (1982).
Li et al., "Bispecific Antibody to ErbB2 Overcomes Trastuzumab Resistance through Comprehensive Blockade of ErbB2 Heterodimerization," *Cancer Res.*, 73(21): 8471-8483 (2013).
Malfait et al., "ADAMTS-5 deficient mice do not develop mechanical allodynia associated with osteoarthritis following medial meniscal destabilization," *Osteoarthritis Cartilage*, 18: 572-580 (2010).
McGuire-Goldring et al., "In Vitro Activation of Human Chondrocytes and Synoviocytes by a Human Interleukin-1-Like Factor," *Arthritis Rheum.*, 27(6): 654-662 (1984).
Miossec et al., "Targeting IL-17 and TH17 cells in chronic inflammation," *Nat. Rev. Drug. Disc.*, 11(10): 763-776 (2012).
Monnet et al., "Association between the IL-1 family gene cluster and spondyloarthritis," *Ann. Rheum, Dis.*, 71:885-890 (2012).
Morgan et al., "Dissociation of hyperalgesia from fever following intracerebroventricular administration of interleukin-1β in the rat," *Brain Res.*, 1022(1-2): 96-100 (2004).
Morimoto et al., "The Increased Interleukin-13 in Patients with Systemic Lupus Erythematosus: Relations to Other Th1-, Th2-Related Cytokines and Clinical Findings," *Autoimmunity*, 34(1): 19-25 (2001).
Nalbandian et al., "Interleukin-17 and systemic lupus erythematosus: current concepts," *Clin. Exp. Immunol.*, 157(2): 209-215 (2009).
Neuman et al., "An ELISA for PGE2 utilizing monoclonal antibody," *J. Immunoassay & Immunochem.*, 9(2): 159-177 (1988).
Parikh et al., "Urine NGAL and IL-18 are predictive biomarkers for delayed graft function following kidney transplantation," *Am. J. Transplant.*, 6(7): 1639-1645 (2006).
Park and Lee, "Interleukin-17 regulation: an attractive therapeutic approach for asthma," *Respir. Res.*, 11: 78 (2010).
Pelletier et al., "In Vivo Suppression of Early Experimental Osteoarthritis by Interleukin-1 Receptor Antagonist Using Gene Therapy," *Arthritis Rheum.*, 40(6): 1012-1019 (1997).
Pettiphar et al., "Interleukin 1 induces leukocyte infiltration and cartilage proteoglycan degradation in the synovial joint," *Proc. Natl. Acad. Sci. USA*, 83: 8749-8753 (1986).
PIR (Protein Information Resource) Accession No. PC4203, "Ig kappa chain (monoclonal antibody MabA34)—mouse (fragment)," Jan. 11, 2000 (2 pages).
Qi et al, "A bispecific antibody against IL-Iβ and IL-17A is beneficial for experimental rheumatoid arthritis," *Internat'l. Immunopharm.*, 14:770-778 (2012).
Quesada et al., "Do Not Say Ever Never More: The Ins and Outs of Antiangiogenic Therapies," *Curr. Pharmaceut. Des.*, 16: 3932-3957 (2010).
Rahman et al., "Association between the interleukin-1 family gene cluster and psoriatic arthritis," *Arthritis Rheum.*, 54(7): 2321-2325 (2006).
Reichert, J.M., "Bispecific antibodies and ADCs. Once and future kings?" *mAbs*, 3(4): 329-330 (2011).
Sainson et al., "Anti-DII4 therapy: can we block tumour growth by increasing angiogenesis?" *TRENDS Mol. Med.*, 13(9): 389-395 (2007).
Shukla et al., "HER2 specific delivery of methotrexate by dendrimer conjugated anti-Her2 mAB," *Nanotechnology*, 19: 295102 (2008) (7 pages).
Tan et al., "A bispecific antibody against two different epitopes on hepatitis B surface antigen has potent hepatitis B virus neutralizing activity," *mAbs*, 5(6): 946-955 (2013).

(56) References Cited

OTHER PUBLICATIONS

Tarsca et al. "Dual-Variable Domain Immunaglobulin (DVD-Ig™ Technology: A Versatile, Novel Format for the Next Generation of Dual-Targeting Biologics," Chapter 10 in *Bispecific Antibodies*. Roland E. Kontermann (ed.), Springer, New York, 2011; pp. 171-185.
Torisu et al., "Discovery of a new class of potent, selective, and orally active prostaglandin $D_2$ receptor antagonists," *Bioorg. Med. Chem.*, 12: 5361-5378 (2004).
U.S. Appl. No. 12/431,460, filed Apr. 28, 2009 by Ghayur et al.: Notice of Allowance, Jan. 8, 2015.
U.S. Appl. No. 12/431,460, filed Apr. 28, 2009 by Ghayur et al.: Final Office Action, Aug. 7, 2014.
U.S. Appl. No. 12/431,460, filed Apr. 28, 2009 by Ghayur et al.: Non-Final Office Action, Apr. 4, 2014.
U.S. Appl. No. 12/477,668, filed Jun. 3, 2009 by Ghayur et al.: Non-Final Office Action, Mar. 10, 2014.
U.S. Appl. No. 12/477,711, filed Jun. 3, 2009 by Ghayur et al.: Non-Final Office Action, Jul. 29, 2014.
U.S. Appl. No. 12/477,711, filed Jun. 3. 2009 by Ghayur et al.: Final Office Action, Feb. 7, 2014.
U.S. Appl. No. 12/477,711, filed Jun. 3, 2009 by Ghayur et al.: Non-Final Office Action, Jul. 17, 2013.
U.S. Appl. No. 12/499,652, filed Jul. 8, 2009 by Ghayur et al.: Notice of Allowance, Apr. 10, 2014.
U.S. Appl. No. 12/631,483, filed Dec. 4, 2009 by Jakob et al.: Non-Final Office Action, May 27, 2014.
U.S. Appl. No. 12/771,871, filed Apr. 30, 2010 by Ghayur et al.: Non-Final Office action, Apr. 15, 2014.
U.S. Appl. No. 12/771,871, filed Apr. 30, 2010 by Ghayur et al.: Final Office Action, May 28, 2013.
U.S. Appl. No. 12/846,317, filed Jul. 29, 2010 by Ghayur et al.: Final Office Action, Nov. 6, 2013.
U.S. Appl. No. 12/846,317, filed Jul. 29, 2010 by Ghayur et al.: Final Office Action, May 23, 2013.
U.S. Appl. No. 12/873,926, filed Sep. 1. 2010 by Ghayur et al.: Notice of Allowance, Jul. 24, 2013.
U.S. Appl. No. 12/905,474, filed Oct. 15, 2010 by Ghayur et al.: Notice of Allowance, Jan. 10, 2014.
U.S. Appl. No. 12/914,614, filed Oct. 28, 2010 by Ghayur et al.: Notice of Allowance, Jan. 10, 2014.
U.S. Appl. No. 12/914,614, filed Oct. 28, 2010 by Ghayur et al.: Non-Final Office Action, Jun. 6, 2013.
U.S. Appl. No. 13/178,641, filed Jul. 8, 2011 by Ghayur et al.: Non-Final Office Action, Dec. 17, 2014.
U.S. Appl. No. 13/196,138, filed Aug. 2, 2011 by Ghayur et al.: Notice of Allowance, Jan. 16, 2014.
U.S. Appl. No. 13/217,937, filed Aug. 25, 2011 by Ghayyr et al.: Notice of Allowance, Feb. 13, 2015.
U.S. Appl. No. 13/217,937, filed Aug. 25, 2011 by Ghayur et al.: Non-Final Office Action, Aug. 22, 2014.
U.S. Appl. No. 13/286,707, filed Nov. 1, 2011 by Ghayur et al.: Non-Final Office Action, Jan. 29, 2014.
U.S. Appl. No. 14/068,976, filed Oct. 21, 2013 by Gu et al.: Non-Final Office Action, Feb. 4, 2015.
Witkowski et al., "Interleukin-17: A mediator of inflammatory responses," *Cell Mol. Life Sci.*, 61: 567-579 (2004).
Wong et al., "Hyperproduction of IL-23 and IL-17 in patients with systemic lupus erythematosus: Implications for Th1-mediated inflammation in autoimmunity," *Clin. Immunol.*, 137(3): 385-393 (2008).
Yao et al., "Human IL-17: A Novel Cytokine Derived from T Cells." *J. Immunol.*, 155: 5483-5486 (1995).
Yao et al., "Molecular characterization of the human Interleukin (IL)-17 receptor," *Cytokine*. 9(11): 794-800.
Yu et al., "Boosting Brain Uptake of a Therapueutic Antibody by Reducing Its Affinity for a Transcytosis Target," *Sci. Transl. Med.*, 3(84):84ra44, 8 pages (2011).

Zhang et al., "Direct chitosan-mediated gene delivery to the rabbit knee joints in vitro and in vivo," *Biochem. Biophys. Res. Commun.*, 341: 202-208 (2006).
"Adalimumab," in *The Merck Index*. 14th Ed., John Wiley & Sons, 2006; pp. 26-27.
"Cetuximab," in *The Merck Index*. 14th Ed., John Wiley & Sons, 2006; p. 335.
"Infliximab," in *The Merck Index*. 14th Ed., John Wiley & Sons, 2006; p. 863.
"Rituximab," in *The Merck Index*. 14th Ed., John Wiley & Sons, 2006; p. 1422.
"Trastuzumab," in *The Merck Index* 14th Ed., John Wiley & Sons, 2006; p. 1646.
T Hart et al., "Suppression of Ongoing Disease in a Nonhuman Primate Model of Multiple Sclerosis by a Human-Anti-Human IL-12p40 Antibody," *J. Immunol.*, 175(7): 4761-4768 (2005).
Alderson et al., "Regulation of apoptosis and T cell activation by Fas-specific mAb," *Int. Immunol.*, 6(11): 1799-1606 (1994).
Alegre et al., "An Anti-Murine CD3 Monoclonal Antibody with a Low Affinity for Fcγ Receptors Suppresses Transplantation Responses While Minimizing Acute Toxicity and Immunogenicity.," *J. Immunol.*, 155: 1544-1555 (1995).
Alt et al., "Novel tetravalent and bispecific IgG-like antibody molecules combining single-chain diabodies with the immunoglobulin g1 Fc or CH3 region," *FEBS Letters*, 454: 90-94 (1999).
Ames et al., "Conversion of murine Fabs isolated from a combinatorial phage display library to full length immunoglobulins," *J. Immunol. Methods*, 184: 177-186 (1995).
Andrew et al., "Fragmentation of Immunoglobulin G," *Current Protocols in Cell Biology*, 16.4.1-16.4.10 (2000).
Andrew et al., "Fragmentation of Immunoglobulin G," *Current Protocols in Cell Biology*, 2.8.1-2.8.10 (1997).
Aoki et al., "Endothelial Progenitor Cell Capture by Stents Coated with Antibody Against CD34," *J. Am. Coll. Cardiol.*, 45(10): 1574-1578 (2005).
Arancio et al., "RAGE potentiates A-62 -induced perturbation of neuronal function in transgenic mice," *EMBO J.*, 23: 4096-4105 (2004).
Arndt et al., "Bispecific Diabodies for Cancer Therapy." *Methods Mol. Biol.*, 207: 305-321 (2003).
Azzazy et al., "Phage display technology: clinical applications and recent innovations," *Clin. Biochem.*, 35: 425-445 (2002).
Babcook et al., "A novel strategy for generating monoclonal antibodies from single, isolated lymphocytes producing antibodies of defined specificities," *Proc. Natl. Acad. Sci. USA*, 93: 7843-7848 (1996).
Bäckström et al., "Signaling Efficiency of the T Cell Receptor Controlled by a Single Amino Acid in the b Chain Constant Region," *J. Exp. Med.*, 186 (11): 1933-1938 (1997).
Balthasar et al., "High-affinity rabbit antibodies directed against methotrexate: Production, purification, characterization, and pharmacokinetics in the rat," *J. Pharm. Sci.*, 84(1): 2-6 (1995) (abstract only) (1 page).
Balthasar et al., "Inverse Targeting of Peritoneial Tumors: Selective Alteration of the Disposition of Methotrexate through the Use of Anti-Methotrexate Antibodies and Antibody Fragments," *J. Pharm. Sci.*, 85(10): 1035-1043 (1996).
Barbas et al., "Assembly of combinatorial antibody libraries on phage surfaces: The gene III site," *Proc. Natl. Acad. Sci. USA*, 88: 7978-7982 (1991).
Barbas et al., "In vitro evolution of a neutralizing human antibody to human immunodeficiency virus type 1 to enhance affinity and broaden strain cross-reactivity," *Proc. Natl. Acad. Sci. USA*, 91: 3809-3813 (1994).
Barrios et al., "Length of the antibody heavy chain complementarity determining region 3 as a specificity-determining factor," *J. Mol. Recog.*, 17: 332-338 (2004).
Baslund et al., "Targeting interleukin-15 in patients with rheumatoid arthritis," *Arthritis Rheum.*, 52(9): 2686-2692 (2005).
Baumgartner et al., "Double blind, placebo controlled trial of tumor necrosis factor receptor fusion protein (TNFR:Fc) in active rheumatoid arthritis," Biomedicine '96. Medical Research from Bench

(56) References Cited

OTHER PUBLICATIONS to Bedside. Washington, DC, May 3-6, 1996. *J. Invest. Med.*, 44(3)235A (Mar. 1996) (Abstract) (1 page).
Berzofsky et al., "Immunogenicity and Antigen Structure," in *Fundamental Immunology*, (Paul, W.E. ed.), New York, NY: Raven Press, 1993; Chapter 8, p. 242 (1 page).
Bessis et al., "Use of hollow fibers filled with cells engineered to secrete IL-4 or IL-13 for treatment of experimental arthritis," (Abstract No. 1681), *Arthritis Rheum.*, 39(9Suppl.): S308 (1996) (1 page).
Better et al., "*Escherichia coli* Secretion of an Active Chimeric Antibody Fragment," *Science*, 240: 1041-1043 (1988).
Biewenga et al., "IgA1 half molecules in human multiple myeloma and the in vitro production of similar fragments from intact IgA1 molecules," *Clin. Exp. Immunol.*, 51: 395-400 (1983).
Bird et al., "Single-Chain Antigen-Binding Proteins," *Science*, 242: 423-426 (1988).
Bornemann et al., "Aβ-Induced inflammatory Processes in Microglia Cells of APP23 Transgenic Mice," *Am. J. Pathol.*, 158(1): 63-73 (2001).
Boyce et al., "No audible wheezing: Nuggets and conundrums from mouse asthma models," *J. Exp. Med.*, 201(12): 1869-1873 (2005).
Brand, D.D., "Rodent Models of Rheumatoid Arthritis," *Comparative Medicine*, 55(2): 114-122 (2005).
Bree et al., "IL-13 blockade reduces lung inflammation after *Ascaris suum* challenge in cynomolgus monkeys,"*J. Allergy Clin. Immunol.*, 119(5): 1251-1257 (2007).
Brennan et al., "Preparation of Bispecific Antibodies by Chemical Recombination of Monoclonal Immunoglobulin $G_1$ Fragments," *Science*, 229: 81-83 (1985).
Brinkmann et al., "Phage display of disulfide-stabilized Fv fragments," *J. Immunol. Methods*, 182 41-50 (1995).
Bruncko et al., "Studies leading to potent, dual inhibitors of Bcl-2 and Bcl-xL," *J. Med. Chem.*, 50(4): 641-662 (2007).
Brüsselbach et al., "Enzyme recruitment and tumor cell killing in vitro by a secreted bispecific single-chain diabody," *Tumor Targeting*, 4: 115-123 (1999).
Buchwald et al., "Long-term, continuous intravenous heparin administration by an implantable infusion pump in ambulatory patients with recurrent venous thrombosis," *Surgery*, 88: 507-516 (1980).
Buras et al., "Animal Models of Sepsis: Setting the Stage," *Nat. Rev. Drug. Discovery*, 4: 854-865 (2005).
Burke et al., "Zotarolimus (ABT-578) eluting stents,"*Adv. Drug Del. Rev.*, 58: 437-446 (2006).
Burton et al., "Human Antibodies from Combinatorial Libraries," *Adv. Immunol.*, 57: 191-280 (1994).
Calandra et al., "Protection from septic shock by neutralization of macrophage migration inhibitory factor," *Nature Med.*, 6(2): 164-170 (2000).
Carroll et al., "The selection of high-producing cell lines using flow cytometry and cell sorting," *Expert Opin. Biol. Ther.*, 4: 1821-1829 (2004).
Carter et al., "Humanization of an anti-p185$^{HER2}$ antibody for human cancer therapy" *Proc. Natl. Acad. Sci. USA*, 89: 4285-4289 (1992).
Casset et al., "A peptide mimetic of an anti-CD4 monoclonal antibody by rational design," *Biochem. Biophys. Res. Commun.*, 307: 198-205 (2003).
Chayen, N.E., "Turning protein crystallisation from an art into a science" *Curr. Opin. Struct. Biol.*, 14:577-583 (2004).
Chayen et al., "Protein crystallization: from purified protein to diffraction-quality crystal," *Nature Methods*,5(2): 147-153 (2008).
Chen et al., "Selection and analysis of an optimized anti-VEGF antibody: Crystal structure of an affinity matured Fab in complex with antigen," *J. Mol. Biol.*, 293: 865-881 (1999).
Chikanza et al., "Treatment of patients with rheumatoid arthritis with RP73401 phosphodiesterase Type IV inhibitor," (Abstract No. 1527) *Arthritis Rheum.*, 39(9 Suppl ): S282 (1996) (1 page).

Choi et al., "Recombinant chimeric OKT3 scFv IgM antibodies mediate immune suppression while reducing T cell activation in vitro," *Eur. J. Immunol.*, 31(1): 94-106 (2001).
Chothia et al., "Canonical Structures for the Hypervariable Regions of Immunoglobulins," *J. Mol. Biol.*, 196: 901-917 (1987).
Chothia et al., "Conformations of immunoglobulin hypervariable regions," *Nature*, 342: 877-883 (1989).
Clackson et al., "Making antibody fragments using phage display libraries," *Nature*, 352: 624-628 (1991).
Cleek et al., "Biodegradable Polymeric Carriers for a bFGF Antibody for Cardiovascular Application," *Proceed. Intl. Symp. Control. Rel. Bioact. Mater.*, 24: 853-854 (1997).
Co et al., "Genetically Engineered Deglycosylatin of the Variable domain Increases the Affinity of an Anti-CD33 Monoclonal Antibody," *Mol. Immunol.*, 30(15): 1361-1367 (1993).
Coffman et al., "Nonhuman primate models of asthma," *J. Exp. Med.*, 201(12): 1875-1879 (2005).
Colman, "Effects of amino acid sequence changes on antibody-antigen interactions," *Research in Immunology*, 145:33-36 (1994).
Coloma et al., "Design and production of novel tetravalent bispecific antibodies," *Nature Biotechnol.*, 15: 159-163 (1997).
Cot et al., "Production and characterization of highly specific anti-methotrexate monoclonal antibodies," *Hybridoma*, 6(1): 87-95 (1987).
Cox et al., "Measurement of cytokine release at the single cell level using the ELISPOT assay," *Methods*, 38(4): 274-282 (2006).
D'Andrea et al., "Production of Natural Killer Cell Stimulatory Factor (Interleukin 12 by Peripheral Blood Mononuclear Cells)," *J. Exp. Med.*, 176: 1387-1398 (1992).
Dall'acqua et al., "Contribution of Domain Interface Residues to the Stability of Antibody $C_H3$ Domain Homodimers," *Biochemistry*, 37: 9266-9273 (1998).
Dall'Acqua et al., "Increasing the affinity of a human IgG1 for the neonatal Fc receptor: Biological consequences," *J. Immunol.*, 169(9): 5171-5180 (2002).
Dall'acqua et al., "Properties of human IgG1s engineered for enhanced binding to the neonatal Fc receptor (FcRn)," *J. Biol. Chem.*, 281: 23514-23524
David et al., "Characterization of monoclonal antibodies against prostaglandin $E_2$: Fine specificity and neutralization of biological effects," *Mol. Immunol.*, 22(3):339-346 (1985).
De Pascalis et al., "Grafting of 'Abbreviated' Complementarity-Determining Regions Containing Specificity-Determining Residues Essential for Ligand Contact to Engineer a Less Immunogenic Humanized Monoclonal Antibody," *J. Immunol.*, 169: 3076-3084 (2002).
Deane et al., "RAGE mediates amyloid-β peptide transport across the blood-brain barrier and accumulation in brain," *Nature Med.*, 9(7): 907-913 (2003).
DeLuca et al., "Marine and botanical lipids as immunomodulatory and therapeutic agents in the treatment of rheumatoid arthritis," *Rheum. Dis. Clin. North Am.*, 21: 759-777 (1995).
Descotes, J., "Immunotoxicology of Immunomodulators," *Develop. Biol. Standard*, 77: 99-102 (1992).
Desmet et al., "Anchor profiles of HLA-specific peptides analysis by a novel affinity scoring method and experimental validation," *Proteins*, 58: 53-69 (2005).
Desplat-Jego et al., "Anti-TWEAK monoclonal antibodies reduce immune cell infiltration in the central nervous system and severity of experimental autoimmune encephalomyelitis," *Clin. Immunol.*, 117(1):15-23 (2005).
Dickson, B.J., "Molecular Mechanisms of Axon Guidance," *Science*, 298: 1959-1964 (2002).
DiGiammarino et al., "Ligand association rates to the inner-variable-domain of a dual-variable-domain immunoglobulin are significantly impacted by linker design," *mAbs*, 3(5): 487-494 (2011).
Dinarello et al., "Measurement of soluble and membrane-bound interleukin 1 using a fibroblast bioassay," Unit 6.2, In *Current Protocols in Immunology*, pp. 6.21-6.27 (2000) (7 pages).
Dohi et al., "Effect of combination Treatment with TNF Inhibitor and Anti-TWEAK Antibody in Mouse Colitis Model," *Gastroenterology*, 138(5): 3-413 Abstract M1758 (2010).

(56) References Cited

OTHER PUBLICATIONS

Domeniconi et al., "Overcoming inhibitors in myelin to promote axonal regeneration," *J. Neurological Sciences*, 233: 43-47 (2005).
During et al., "Controlled Release of Dopamine from a Polymeric Brain Implant: In Vivo Characterization," *Ann. Neurol.*, 25(4): 351-356 (1989).
Durocher et al., "High-level and high-throughput recombinant protein production by transient transfection of suspension-growing human 293-EBNA1 cells," *Nucl. Acids Res.*, 30(2): e9, (9 pages) (2002).
Economides et al., "Cytokine traps: multi-component, high-affinity blockers of cytokine action," *Nature Med.*, 9(1): 47-52 (2003).
Ehrich et al., "Demonstration of selective COX-2 inhibition by MK-966 in humans," (Abstract No. 328), *Arthritis Rheum.*, 39(9 Suppl.): S81 (1996) (1 page).
Ehrich et al., "Efficacy of MK-966, a highly selective inhibitor of COX-2, in the treatment of postoperative dental pain," (Abstract No. 329), *Arthritis Rheum.*, 39(9Suppl.): S81 (1996) (1 page).
European Patent Application No. 06813544.0: Supplementry European Search Report and Search Opinion, dated Sep. 21, 2009 (11 pages).
European Patent Application No. 07811045.9: Supplementary European Search Report and Search Opinion, dated Sep. 21, 2009 (7 pages).
European Patent Application No. 09739578.4: Supplementary European Search Report and Search Opinion, dated Mar. 28, 2012 (21 pages).
European Patent Application No. 09759344.6: Supplementary European Search Report and Search Opinion, dated Jun. 13, 2012 (12 pages).
European patent Application No. 09759348.7: Supplementary European Search Report and Search Opinion, dated Jul. 4, 2012 (11 pages).
European Patent Application No. 09795128.9: Supplementary European Search Report and Search Opinion, dated May 22, 2013 (10 pages).
European Patent Application No. 09831213.5: Supplementary European Search Report and Search Opinion, dated Oct. 21, 2013 (6 pages).
European Patent Application No. 10770441.3 Supplementary European Search Report and Search Opinion, dated Sep. 23, 2013 (16 pages).
European Patent Application No. 10805046.9: Supplementary European Search Report and Search Opinion, dated Mar. 26, 2013 (7 pages).
European Patent Application No. 10824164.7: Supplementary European Search Report and Search Opinion, dated May 22, 2013 (11 pages).
European Patent Application No. 11804385.0: Supplementary European Search Report and Search Opinion, dated Nov. 20, 2013 (16 pages).
European Patent Application No. 11798923.6: Supplementary European Search Report and Search Opinion, dated Jan. 2, 2014 (10 pages).
European Patent Application No. 11820654.9: Supplementary European Search Report and Search Opinion, dated Dec. 17, 2013 (17 pages).
Evans et al., "Efficacy of tumor necrosis factor binding protein (TNF-bp) in the streptococcal cell wall-induced reactivation model of arthritis," (Abstract No. 1540), *Arthritis Rheum.*, 39(9 Suppl.): S284 (1996) (1 page).
Ewert et al., "Stability improvement of antibodies for extracellular and intracellular applications: CDR grafting to stable frameworks and structure-based framework engineering," *Methods*, 34: 184-199 (2004).
Farr et al., "Sulphasalazine (SASP) in rheumatoid arthritis (RA): A 5 year prospective study," (Abstract No. 1519), *Arthritis Rheum.*, 39(9 Suppl.): S251 (1996) (1 page).

Fiebich et al., "Effects of NSAIDs on IL-1-beta-induced IL-6 mRNA and protein synthesis in human astrocytoma cells," *NeuroReport*, 7: 1209-1213 (1996).
Finnegan et al., "Leflunomide inhibits immunoglobulin production by two separate mechanisms," (Abstract No. 627), *Arthritis Rheum.*, 39(9 Suppl.): S131 (1996) (1 page).
Finotto, et al., "Asthmatic changes in mice lacking T-bet are mediated by IL-13," *Int. Immunol.*, 17(8): 993-1007 (2005).
Fuchs et al., "Targeting Recombinant Antibodies to the Surface of *Escherichia coli*: Fusion to a Peptidoglycan Lipoprotein" *Bio/Technology*, 9: 1369-1372 (1991).
Fuh et al., "Structure-Function Studies of Two Synthetic Anti-vascular Endothelial Growth Factor Fabs and Comparison with the Avastin™ Fab," *J. Biol. Chem.*, 281(10):6625-6631 (2006).
Garrard et al., "$F_{AB}$ Assembly and Enrichment in a Monovalent Phage Display System," *Bio/Technology*, 9: 1373-1377 (1991).
Gavilondo et al., "Antibody Engineering at the Millennium," *Biotechniques*, 29: 128-145 (2000).
Genain et al., "Creation of a model for multiple sclerosis in *Callithrix jacchus* marmosets," *J. Mol. Med.*, 75(3): 187-197 (1997).
GenBank Accession No. U17870, "Cricetulus migratorius 145 2c11 kappa light chain mRNA, complete cds," ROD Feb. 7, 1996 (2 pages).
GenBank Accession No. U17871, "Cricetulus migratorius 145.2c11 heavy chain mRNA, partial cds," Feb. 7, 1996 (2 pages).
GenBank Accession No. X99230, "M.musculus mRNA for immunoglobulin heavy chain variable domain, subgroup IIb," ROD Oct. 8. '1996 (2 pages).
GenBank Accession No. X99232, "M.musculus mRNA for immunoglobulin light chain variable domain, subgroup III," ROD Oct. 8, 1996 (2 pages).
GenBank Accession No. Y14283, "Mus musculus mRNA for immunoglobulin heavy chain variable region. subunits VH, DH and JH" ROD May 26, 1998 (2 pages).
GenBank Accession No. Y14284, "Mus musculus mRNA for immunoglobulin light chain variable region, subunits VL and JL," ROD May 26, 1998 (2 pages).
Genovese et al., "Abatacept for Rheumatoid Arthritis Refractory to Tumor Necrosis Factor α Inhibition," *N. Engl. J. Med.*, 353: 1114-1123 (2005).
Germain et al., "Redirecting NK cells mediated tumor cell lysis by a new recombinant bifunctional protein," *Protein Engineering Design and Selection*, 21(11):665-672 (2008)
Ghetie et al., "Increasing the serum persistence of an IgG fragment by random mutagenesis," *Nature Biotechnol.*, 15(7): 637-640 (1997).
Giegé et al., Chapter 1, In *Crystallization of Nucleic Acids and Proteins, a Practical Approach*, 2nd ed., (Ducruix and Giegé, eds.) (Oxford University Press, New York, 1999) pp. 1-16.
Glennie et al., "Preparation and Performance of Bispecific F(ab'γ)$_2$ Antibody Containing Thioether-Linked Fab'γ Fragments," *J. Immunol.*, 139(7): 2367-2375 (1987).
Goldspiel et al., "Human Gene Therapy," *Clin. Pharm.*, 12: 488-505 (1993).
Goodson, J.M., "Dental Applications," Chapter 6, In Medical Applications of Controlled Release, vol. II, Applications and Evaluation, (Langer and Wise, eds.) (CRC Press, Inc., Boca Raton, 1984), pp. 115-138.
Gracie et al., "A proinflammatory role for IL-18 in rheumatoid arthritis," *J. Clin. Invest.*, 104(10): 1393-1401 (1999).
Gram et al., "In vitro selection and affinity maturation of antibodies from a naive combinatorial immunoglobulin library," *Proc. Natl. Acad. Sci. USA*, 89: 3576-3580 (1992).
Green et al., "Antigen-specific human monoclonal antibodies from mice engineered with human Ig heavy and light chain YACs," *Nature Genetics*, 7: 13-21 (1994).
Green et al., "Regulation of B Cell Development by Variable Gene Complexity in Mice Reconstituted with Human Immunoglobulin Yeast Artificial Chromosomes," *J. Exp. Med.*, 188(3): 483-495 (1998).

(56) References Cited

OTHER PUBLICATIONS

Griffin et al., "Blockade of T Cell Activation Using a Surface-Linked Single Chain Antibody to CTLA-4 (CD152)." *J. Immunol.*, 164: 4433-4442 (2000).
Griffiths et al., "Human anti-self antibodies with high specificity from phage display libraries," *EMBO J.*, 12(2): 725-734 (1993).
Güssow et al., "Humanization of Monoclonal Antibodies," *Methods Enzymol.*, 203: 99-121 (1991).
Guttadauria, M., "Tenidap in Rheumatoid Arthritis Collaborative International Study (TRACIS): a 6-month interim analysis," (Abstract No. 1516), *Arthritis Rheum.*, 39(9 Suppl.): S280 (1996) (1 page).
Hammerling et al., eds., "Appendix: Production of Antibody-Producing Hybridomas in the Rodent Systems," In *Monoclonal Antibodies and T-Cell Hybridomas Research Monographs in Immunology*, vol. 3. (J.L. Turk, General Editor) (Elsevier, New York, 1981), pp. 563-587.
Hanasaki et al., "Binding of Human Plasma Sialoglycoproteins by the B Cell-specific Lectin CD22," *J. Biol. Chem.*, 27(13): 7543-4550 (1995).
Hara et al., "Therapeutic effect of T-614, a new anti-arthritic agent, on rheumatoid arthritis," (Abstract No. 1526), *Arthritis Rheum.*, 39(9 Suppl.): S282 (1996) (1 page).
Harriman et al., "Summary of clinical trials in rheumatoid arthritis using infliximab, an anti-TNFα treatment," *Ann. Rheum. Dis.*, 58(Suppl. 1): I61-I64 (1999) (4 pages).
Hart et al., "Preclinical efficacy and safety of mepolizumab (SB-240563), a humanized monoclonal antibody to IL-5, in cynomolgus monkeys," *J. Allergy Clin. Immunol.*, 108(2): 250-257 (2001).
Hawkins et al., "Selection of Phage Antibodies by Binding Affinity Mimicking Affinity Maturation," *J. Mol. Biol.*, 226: 839-896 (1992).
Hay et al., "Bacteriophage cloning and *Escherichia coli* expression of a human IgM Fab," *Hum. Antibod. Hybridomas*, 3: 81-85 (1992).
Henry et al., "A Prostate-Specific Membrand Antigen Targeted Monoclonal Antibody-Chemotherapeutic Conjugate Designed for the Treatment of Prostate Cancer," *Cancer Res.*, 64: 7995-8001 (2004).
Hickey et al., "The Rheumatoid Arthritis Azathioprine Registry (RAAF)—interim analysis of maligancy and mortality," (Abstract No. 1521), *Arthritis Rheum.*, 39(9 Suppl.): S281 (1996) (1 page).
Hildebrand et al., "Surface coatings for biological activation and functionalization of medical devices," *Surface & Coatings Technology*, 200: 6318-6324 (2006).
Hinton et al., "Engineered human IgG antibodies with longer serum half-lives in primates," *J. Biol. Chem.* 279(8): 6213-6216 (2004).
Holliger et al., "'Diabodies': Small bivalent and bispecific antibody fragments" *Proc. Natl. Acad. Sci. USA*, 90: 6444-6448 (1993).
Holliger et al., "Diabodies: Small bispecific antibody fragments," *Cancer Immunol. Immuother.*, 45: 128-130 (1997).
Holm et al., "Functional mapping and single chain construction of the anti-cytokeratin 8 monoclonal antibody TS1," *Mol. Immunol.*, 44. 1075-1084 (2007).
Hoogenboom et al., "Multi-subunit proteins on the surface of filamentous phage: Methodologies for displaying antibody (Fab) heavy and light chains," *Nucl. Acids Res.*, 19(15): 4133-4137 (1991).
Hoogenboom et al., "Natural and designer binding sites made by phage display technology," *Immunol. Today*, 21(8): 371-378 (2000).
54Hoogenboom, H.R., "Designing and optimizing library selection strategies for generating high-affinity antibodies," *Trends Biotechnol.*, 15: 62-70 (1997).
Hoogenboom, H.R., "Mix and match: Building manifold binding sites," *Nature Biotechnol.*, 15: 125-126 (1997).
Howard et al., "Intracerebral drug delivery in rats with lesion-induced memory deficits," *J. Neurosurg.*, 71: 105-112 (1989).
Huber et al., "Crystallographic structure studies of an IgG molecule and an Fc fragment," *Nature*, 264: 415-420 (1976).
Huse et al., "Generation of a Large Combinatorial Library of the Immunoglobulin Repertoire in Phage Lambda," *Science*, 246: 1275-1281 (1989).
Huston et al., "Protein engineering of antibody binding sites: Recovery of specific activity in an anti-digoxin single-chain Fv analogue produced in *Escherichia coli*," *Proc. Natl. Acad. Sci. USA*, 85: 5879-5883 (1988).
Huston et al., "Protein Engineering of Single-Chain Fv Analogs and Fusion Proteins," *Methods Enzymol.*, 203: 46-88 (1991).
Hwang et al., "Cutting Edge: Targeted Ligation of CTLA-4 In Vivo by Membrane-Bound Anti-CTLA-4 Antibody Prevents Rejection of Allogeneic Cells,", *J. Immunol.*, 163: 633-637 (2002).
Inter Partes Reexamination (Control No. 95/001,380) of U.S. Pat. No. 7,612,181 (U.S. Appl. No. 11/507,050): Replacement Request, dated Jun. 24, 2010 (62 pages).
Inter Partes Reexamination (Control No. 95/001,380) of U.S. Pat. No. 7,612,181 (U.S. Appl. No. 11/507,050): Order Granting Request for Inter Partes Reexamination, issued Sep. 1, 2010 (18 pages).
Inter Partes Reexamination (Control No. 95/001,380) of U.S. Pat. No. 7,612,181 (U.S. Appl. No. 11/507,050): Reexamination Non-Final Office Action, dated Sep. 1, 2010 (13 pages).
Inter Partes Reexamination (Control No. 95/001,380) of U.S. Pat. No. 7,612,181(U.S. Appl. No. 11/507,050): Response After Non-Final Action—Owner Timely ("Patent Owner's Response Pursuant to 37 CFR § 1.945"), dated Nov. 1, 2010 (71 pages).
Inter Partes Reexamination (Control No. 95/001,380) of U.S. Pat. No. 7,612,181 (U.S. Appl. No. 11/507,050): Third Party Requester Comments After Non-Final Action ("Sanofi's Comments Pursuant to 37 CFR § 1.947"), dated Dec. 1, 2010 (81 pages).
Inter Partes Reexamination (Control No. 95/001,380) of U.S. Pat. No. 7,612,181 (U.S. Appl. No. 11/507,050): Reexamination Non-Final Office Action ("Action Closing Prosecution"), dated Sep. 1, 2011.
Inter Partes Reexamination (Control No. 95/001,380) of U.S. Pat. No. 7,612,181 (U.S. Appl. No. 11/507,050): Patent Owner Comments After Action Closing Prosecution ("Response Pursuant to 37 CFR § 1.951(a)"), dated Oct. 31, 2011.
Inter Partes Reexamination (Control No. 95/001,380) of U.S. Pat. No. 7,612,181 (U.S. Appl. No. 11/507,050): Third Party Requester Comments after Action Closing Prosecution ("Sanofi's Comments Pursuant to 37 CFR §1.951(a)"), dated Nov. 30, 2011.
Inter Partes Reexamination (Control No. 95/001,380) of U.S. Pat. No. 7,612,181 (U.S. Appl. No. 11/507,050): Right of Appeal Notice (37 CFR 1.953), dated Mar. 7, 2012.
International Patent Application No. PCT/US2006/032398: International Preliminary Report on Patentability, dated Jul. 6, 2010 (14 pages).
International Patent Application No. PCT/US2006/032398: International Search Report and Written Opinion, dated Aug. 18, 2008 (14 pages).
International Patent Application No. PCT/US2007/017340: International Preliminary Report on Patentability, dated Nov. 14, 2008 (3 pages).
International Patent Application No. PCT/US2007/017340: International Search Report and Written Opinion, dated Jun. 24, 2008 (5 pages).
International Patent Application No. PCT/US2009/041945: International Preliminary Report on Patentability, dated Aug. 9, 2010 (12 pages).
International Patent Application No. PCT/US2009/041945: International Search Report and Written Opinion, dated Nov. 2, 2009 (12 pages).
International Patent Application No. PCT/US2009/046130: International Preliminary Report on Patentability, dated Aug. 21, 2010 (13 pages).
International Patent Application No. PCT/US2009/046130: International Search Report and Written Opinion, dated Jan. 11, 2010 (17 pages).
International Patent Application No. PCT/US2009/046137: International Preliminary Report on Patentability, dated Jun. 18, 2010 (14 pages).
International Patent Application No. PCT/US2009/046137: International Search Report and Written Opinion, dated Jan. 12, 2010 (18 pages).

(56) References Cited

OTHER PUBLICATIONS

International Patent Application No. PCT/US2009/049954: International Preliminary Report on Patentability, dated Jul. 2, 2011 (11 pages).
International Patent Application No. PCT/US2009/049954: International Search Report and Written Opinion, dated Mar. 31, 2010 (14 pages).
International Patent Application No. PCT/US2009/066815: International Preliminary Report on Patentability, dated Jan. 6, 2011 (13 pages).
International Patent Application No. PCT/US2009/066815: International Search Report and Written Opinion, dated Mar. 23, 2010 (14 pages).
International Patent Application No. PCT/US2010/033231: International Preliminary Report on Patentability, dated Apr. 27, 2011 (10 pages).
International Patent Application No. PCT/US2010/033231, International Search Report and Written Opinion, dated Nov. 22, 2010 (10 pages).
International Patent Application No. PCT/US2010/033246: International Preliminary Report on Patentability, dated May 4, 2011 (28 pages).
International Patent Application No. PCT/US2010/033246: International Search Report and Written Opinion, dated Nov. 24, 2010 (18 pages).
International Patent Application No. PCT/US2010/043716: International Preliminary Report on Patentability, dated Aug. 31, 2012 (24 pages).
International Patent Application No. PCT/US2010/043716: International Search Report and Written Opinion, dated Feb. 28, 2011 (17 pages).
International Patent Application No. PCT/US2010/047543: International Search Report and Written Opinion, dated Feb. 24, 2011 (14 pages).
International Patent Application No. PCT/US2010/052843: International Search Report and Written Opinion, dated Jul. 1, 2011 (21 pages).
International Patent Application No. PCT/US2010/053730: International Preliminary Report on Patentability, dated Nov. 21, 2011 (12 pages).
International Patent Application No. PCT/US2010/053730: International Search Report and Written Opinion, dated May 6, 2011 (13 pages).
International Patent Application No. PCT/US2010/054521: International Preliminary Report on Patentability, dated Feb. 8, 2012 (12 pages).
International Patent Application No. PCT/US2010/054521: International Search Report and Written Opinion, dated May 26, 2011 (12 pages).
International Patent Application No. PCT/US2011/041633: International Search Report and Written Opinion, dated Mar. 13, 2012 (16 pages).
International Patent Application No. PCT/US2011/043297: International Search Report and Written Opinion, dated Feb. 28, 2012 (19 pages).
International Patent Application No. PCT/US2011/046233: International Search Report and Written Opinion, dated Apr. 3, 2012 (17 pages).
International Patent Application No. PCT/US2011/049147: International Search Report and Written Opinion, dated Mar. 21, 2012 (16 pages).
International Patent Application No. PCT/US2011/058769: International Search Report and Written Opinion, dated Jun. 15, 2012 (15 pages).
International Patent Application No. PCT/US2011/059074: International Search Report and Written Opinion, dated Jun. 15, 2012 (18 pages).
International Patent Application No. PCT/US2012/071897: International Search Report and Written Opinion, dated Sep. 3, 2013 (17 pages).
International Patent Application No. PCT/US2012/072017: International Search Report and Written Opinion, dated Jul. 17, 2013 (24 pages).
International Patent Application No. PCT/US2012/071929: International Search Report and Written Opinion, dated Sep. 11, 2013 (29 pages).
Ito et al., "Transfer of Severe Experimental Autoimmune Encephalomyelitis by IL-12- and IL-18-Potentiated T Cells is Estrogen Sensitive," *J. Immunol.*, 170(9): 4802-4809 (2003).
Jackson et al., "In Vitro Antibody Maturation, Improvement of a High Affinity, Neutralizing Antibody Against IL-1β," *J. Immunol.*, 154(7): 3310-3319 (1995).
Jakubowskei et al., "Dual role for TWEAK in angiogenic regulation," *J. Cell Sci.*, 115(2)267-274 (2002).
Janelsins et al., "Early correlation of microglial activation with enhanced tumor necrosis factor-alpha and monocyte chemoattractant protein-I expression specifically within the entorhinal cortex of triple transgenic Alzheimer's disease mice," *J. Neuroinflammation*, 2(23): 1-12 (2005).
Janeway et al., *Immunobiology. The Immune System in Health and Disease.* 3rd Ed. Current Biology Ltd./Garland Publishing Inc., 1997; Chapter 3, pp. 1-11.
Jefferis, R., "Glycosylation of Recombinant Antibody Therapuetics," *Biotechnol. Prog.*, 21: 11-16 (2005).
Jendreyko et al., "Intradiabodies, Bispecific, Tetravaient Antibodies for the Simultaneous Functional Knockout of Two Cell Surface Receptors" *J. Biol. Chem.*, 278(48):47812-47819 (2003).
Jiang et al., "Regulation of recombinant monozional antibody production in Chinese hamster ovary cells: A comparative study of gene copy number, mRNA level, and protein expression," *Biotechnol. Prog.*, 22(1): 313-318 (2006).
Jin et al., "Pharmacokinetic and Pharmacodynamic Effects of High-Dose Monoclonal Antibody Therapy in a Rat Model of Immune Thrombocytopenia," *The AAPS Journal*, 7(4):Article 87, E895-E902 (2006) [online]. Retrieved from: http://www.springerlink.com/content/v6n04672761n9313/fulltext.pdf.
Joachimiak, "High-throughput crystallography for structural genomics" *Curr. Opin. Struct. Biol.*, 19:573-584 (2009).
Johnsson et al., "Comparison of Methods for Immobilization to Carboxymethyl Dextran Sensor Surfaces by Analysis of the Specific Activity of Monoclonal Antibodies," *J. Mol. Recognit.*, 8: 125-131 (1995).
Johnsson et al., "Immobilization of Proteins to a Carboxymethyldextran-Modified Gold Surface for Biospecific Interaction Analysis in Surface Plasmon Resonance Sensors," *Anal. Biochem.*, 198: 268-277 (1991).
Joliot et al., "Antennapedia homeobox peptide regulates neural morphogenesis," *Proc. Natl. Acad. Sci. USA*, 88: 1864-1868 (1991).
Jones et al., "Replacing the complementarity-determining regions in a human antibody with those from a mouse," *Nature*, 321: 522-525 (1986).
Jones, A.G., "Particle formation and separation in suspension crystallization processes," Chapter 4, In *Process. Solid-Liq. Suspensions*, (P. Ayazi Shamlou, ed.) (Butterworth-Heinemann, Oxford, UK, 1993) pp. 93-117.
Jones, A.J.S., "Analytical methods for the assessment of protein formulations and delivery systems," Chapter 2, In *Formulation and Delivery of Proteins and Peptides*, 1st ed., (Cleland and Langer, eds.) (American Chemical Society, Washington, D.C., 1994), pp. 22-45.
Jones, R., "Rovelizumab—ICOS Corp," *IDrugs*, 3(4): 442-446 (2000).
Jönsson et al., "Introducing a biosensor based technology for real-time biospecific interaction analysis," *Ann. Biol. Clin.*, 51: 19-26 (1993).
Jönsson, et al., "Real-Time Biospecific Interaction Analysis Using Surface Plasmon Resonance and a Sensor Chip Technology," *BioTechniques*, 11(5): 620-627 (1991).
Joosten et al., "Anticytokine Treatment of Established Type II Collagen-Induced Arthritis in DBA/1 Mice," *Arthritis Rheum.*, 39(5): 797-809 (1996).

(56) References Cited

OTHER PUBLICATIONS

Ju et al., "Inhibitory effects of nardostachin on nitric oxide, prostaglandin E2, and tumor necrosis factor-alpha production in lipopolysaccharide activated macrophages," *Biol. Pharm. Bull.* 25: 1375-1378 (2003).

Jungbluth et al., "A monocolonal antibody recognizing human cancers with amplification/overexpression of the human epidermal growth factor receptor," *Proc. Natl. Acad. Sci USA*, 100(2): 639-644 (2003).

Kabat et al., "Attempts to Locate Complementarity-Determining Residues in the Variable Positions of Light and Heavy Chains," *Ann. NY Acad. Sci.*, 190: 382-391 (1971).

Kaine et al "Results of a multi-dose protocol 7002 using an immunomodulating, non-depleting Primatized™ anti-CD4 monoclonal antibody in rheumatoid arthritis (RA)," (Abstract No. 195), *Arthritis Rheum.*, 38: S185 (1995) (1 page).

Kanda et al., "Establishment of a GDP-mannose 4,6-dehydratase (GMD) knockout host cell line: A new strategy for generating completely non-fucosylated recombinant therapeutics," *J. Biotechnol.*, 130(3): 300-310 (2007).

Kapadia et al., "Soluble TNF binding proteins modulate the negative inotropic properties of TNF-alpha in vitro," *Am. J. Physiol. Heart Circ. Physiol.* 268 (2 Pt. 2): H517-H525 (1995).

Karnezis et al., "The neurite outgrowth inhibitor Noga A is involved in autoimmune-mediated demyelination," *Nature Neurosci.*, 7: 736-744 (2004).

Karni et al., "IL-18 is linked to raised IFN-γ in multiple sclerosis and is induced by activated $CD4^+$ cells via CD40-CD40 ligand interactions," *J. Neuroimmunol.*, 125: 134-140 (2002).

Kashmiri et al., "SDR grafting—a new approach to antibody humanization," *Methds*, 26(1): 25-34 (2005).

Kaufman and Sharp, "Amplification and expression of sequences cotransfected with a modular dihydrofolate reductase complementary DNA gene," *J. Mol. Biol.*, 159(4): 601-621 (1982).

Keith Jr., et al., "Recombinant human interleukin eleven decreases arthritis in HLA-B27 transgenic rats," (Abstract No. 1613), *Arthritis Rheum.*, 39(9 Suppl.): S296 (1996) (1 page).

Kellerman et al., "Antibody discovery: The use of transgenic mice to generate human monoclonal antibodies for therapeutics," *Curr. Opin. Biotechnol.*, 13: 593-597 (2002).

Kettleborough et al., "Humanization of a mouse monoclonal antibody by CDR-grafting: the importance of framework residues on loop conformation," *Protein Eng.*, 4(7): 773-783 (1991).

Kettleborough et al., "Isolation of tumor cell-specific single-chain Fv from immunized mice using phage-antibody libraries and the re-construction of whole antibodies from these antibody fragments," *Eur. J. Immunel.*, 24: 952-958 (1994).

Kim et al., "Identifying amino acid residues that influence plasma clearance of murine IgG1 fragments by site-directed mutagenesis," *Eur. J. Immunol.*, 24; 542-548 (1994).

Kipriyanov et al., "Bispecific CD3×CD19 Diabody for T Cell-Mediated Lysis of Malignant Human B Cells," *Int. J. Cancer*, 77. 763-772 (1998).

Kipriyanov et al., "Generation of recombinant antibodies," *Mol. Biotechnol.*, 12: 173-201 (1999).

Klein, W.L., "Aβ toxicity in Alzheimer's disease: Globular oligomers (ADDLs) as new vacdine and drug targets," *Neurochem. Int.*, 41: 345-351 (2002).

Klyubin et al., "Amyloid β protein immunotherapy neutralizes Aβ oligomers that disrupt synaptic plasticity in vivo," *Nature Med.*, 11: 556-561 (2005).

Köhler and Milstein, "Continuous cultures of fused cells secreting antibody of predefined specificity," *Nature*, 256: 495-497 (1975).

Konishi et al., "A simple and sensitive bioassay for the detection of human interleukin-18/interferon-γ-inducing factor using human myelomonocytic KG-1 cells," *J. Immunol. Methods*, 209 187-191 (1997).

Kontermann, R.E., "Recombinant bispecific antibodies for cancer therapy," *Acta Pharmacologica Sinica*, 26(1): 1-9 (2005).

Kostelny et al., "Formation of a Bispecific Antibody by the Use of Leucine Zippers," *J. Immunol.*, 148(5): 1547-1553 (1992).

Kriangkum et al., "Bispecific and bifunctional single chain recombinant antibodies," *Biomol. Eng.*, 18: 31-40 (2001).

Krop et al., "Self-renewal of B-1 lymphocytes is dependent on CD19," *Eur. J. Immunol.*, 26: 236-242 (1996).

Kuby, *Immunology*, 2nd ed., (W.H. Freeman and Company, New York, 1994), p. 115, Fig. 5-6 (1 page).

Kwong et al., "Generation, affinity maturation, and characterization of a human anti-human NKG2D monoclonal antibody with dual antagonistic and agonistic activity," *J. Mol. Biol.*, 384(5): 1143-1156 (2008).

Lam et al., "Microencapsulation of Recombinant Humanized Monoclonal Antibody for Local Delivery," *Proceed. Intl. Symp. Control Rel. Bioact. Mater.*, 24: 759-760 (1997).

Langer and Pappas, "Chemical and Physical Structure of Polymers as Carriers for Controlled Release of Bioactive Agents: A Review," *J. Macromol. Sci. RMC*, C23(1): 61-126 (1983).

Langer, R., "New Methods of Drug Delivery," *Science*, 249: 1527-1533 (1990).

Laue, T., "Analytical centrifugation: equiiibrium approach," In *Current Protocols in Protein Science*, (John Wiley & Sons, Inc., New York, 1999), Supplement 18, Unit 20.3, pp. 20.3.1-20.3.13 (13 pages).

Le Gall et al., "Di-, tri- and tetrameric sing le chain Fv antibody fragments against human CD19: Effect of valency on cell binding," *FEBS Letters*, 453: 164-168 (1999).

Le Gall et al., "Immunosuppressive properties of anti-CD3 single-chain Fv and diabody," *J. Immunol. Methods*, 285: 111-127 (2004).

Lee et al., "BiP and immunoglobulin light chain cooperate to control the folding of heavy chain and ensure the fidelity of immunoglobulin assembty," M*Mol. Biol. Cell*, 10: 2209-2219 (1999).

Lee et al., "Treatment of rheumatoid arthritis (RA) with thalidomide," (Abstract No. 1524), *Arthritis Rheum.*, 39(9 Suppl.): S282 (1996) (1 page).

Legros et al., "Characterization of an anti-*Borrelia burgdorferi* OspA conformational epitope by limited proteolysis of monoclonal antibody-bound antigen and mass spectrometric peptide mapping," *Protein Science*, 9: 1002-1010 (2000).

Leung et al., "Combined Effects of IL-12 and IL-18 on the Induction of Collagen-Induced Arthrities," *J. Immunol.*, 164(12): 6495-6502 (2000).

Levy et al., "Inhibition of Calcification of Bioprosthetic Heart Valves by Local Controlled-Release Diphosphonate," *Science*, 226: 190-192 (1985).

Li et al., "Structural mutations in the constant region of the T-cell antigen receptor (TCR)β chain and their effect on TCRα and β chain interaction," *Immunology*, 88: 524-530 (1996).

Li et al., "Synergistic effects of IL-12 and IL-18 in skewing tumor-reactive T-cell responses towards a type I pattern," *Cancer Res.*, 65(3): 1063-1070 (2005).

Li et al., "Genetically engineered brain drug delivery vectors: Cloning, expression and in vivo of an anti-transferrin receptor single chain antibody-streptavidin fusion gene and protein," *Protein Eng.*, 12(9): 787-796 (1999)

Little et al., "Of mice and men: hybridoma and recombinant antibodies," *Immunol. Today*, 21(8): 364-370 (2000).

Liu et al., "Heterogeneity of Monoclonal Antibodies," *J. Pharm. Sci.*, 97(7):2426-2447 (2006).

Lloyd et al., "Mouse Models of Allergic Airway Disease," *Adv. Immunol.*, 77: 263-295 (2001).

Lo, B., "Antibody Humanization by CDR Grafting," *Methods Mol. Biol.*, 248: 135-159 (2004).

Lobo, "Anti-Methotrexate Fab Fragments for Optimization of Intraperitoneal Methotrexate Chemotherapy," Dissertation, University of New York at Buffalo, Dept. of Pharmaceutical Sciences, Aug. 2002, pp. 1-243. Avaiiable online at: http://www.acsu.buffalo.edu~jb/Thesis%20080802.pdf.

Lobo et al., "Application of anti-methotrexate Fab fragments for the optimization of intraperitoneal methotrexate therapy in a murine model of peritoneal cancer," *J. Pharma. Sci.*, 94(9): 1957-1964 (2005) (Abstract only) (1 page).

(56) References Cited

OTHER PUBLICATIONS

Lotz et al., "IL-17 promotes cartilage degradation," (Abstract No. 559), *Arthritis Rheum.*, 39(9 Suppl.): A120 (1996) (1 page).
Lu et al., "A Fully Human Recombinant IgG-like Bispecific Antibody to Both the Epidermal Growth Factor Receptor and the Insulin-like Growth Factor Receptor for Enhanced Antitumor Activity," *J. Biol. Chem.*, 280 (20): 19665-19672 (2005).
Lu et al., "Fab-scFv fusion protein: an efficient approach to production of bispecific antibody fragments," *J. Immunol. Methods*, 267:213-226 (2002).
Lu et al., "Di-diabody: A novel tetravalent bispecific antibody molecule by design," *J. Immunol. Methods*, 279: 219-232 (2003).
Lu et al., "Simultaneous Blockade of Both the Epidermal Growth Factor Receptor and the insulin-like Growth Factor Receptor Signaling Pathways in Cancer Cells with a Fully Human Recombinant Bispecific Antibody," *J. Biol. Chem.*, 279(4): 2856-2865 (2004).
Lublin, F.D., "Relapsing Experimental Allergic Encephalomyelitis. An Autoimmune Model of Multiple Sclerosis," *Springer Semin. Immunopathol.*, 8: 197-208 (1985).
Lund et al., "Human Fc gamma RI and Fc gamma RII interact with distinct but overlapping sites on human IgG," *J. Immunol.*, 147: 2657-2662 (1991).
Luster et al., "Use of animal studies in risk assessment for immunotoxicology," *Toxicology*, 92(1-3): 229-243 (1994).
MacCallum et al., "Antibody-antigen Interactions: Contact Analysis and Binding Site Topography," *J. Mol. Biol.*, 262: 732-745 (1996).
Mack et al., "A small bispecific antibody construct expressed as a functional single-chain molecule with high tumor cell cytotoxicity," *Proc. Natl. Acad. Sci. USA.*, 92: 7021-7025 (1995).
Madhusudan et al., "A phase II study of etanercept (Enbrel), a tumor necrosis factor alpha inhibitor in patients with metastatic breast cancer," *Clin. Cancer Res.*, 10(19): 6525-6534 (2004).
Makwana et al., "Molecular mechanisms in successful peripheral regeneration", *FEBS J.*, 272: 2628-2638 (2005).
Malik-Hall et al., "Primary afferent nociceptor mechanisms mediating NGF-induced mechanical hyperalgesia," *Eur. J. Neurosci.*, 21(12): 3387-3394 (2005).
Marchalonis et al., "Evolutionary Factors in the Emergence of the Combinatorial Germline Antibody Repertoire," *Adv. Exp. Med. Biol.*, 484: 13-30 (2001).
Margolin et al., "Protein crystals as novel catalytic materials," *Angew. Chem. Int. Ed.*, 40: 2204-2222 (2001).
Marilizza et al., "The Structural Basis of Antigen-Antibody Recognition," *Annu. Rev. Biophys. Biophys. Chem.*, 16: 139-159 (1987).
Marks et al., "By-Passing Immunization: Building High Affinity Human Antibodies by Chain Shuffling," *BioTechnology*, 10: 779-783 (1992).
Marques et al., "Mediation of the Cytokine Network in the Implantation of Orthopedic Devices," Chapter 21, In *Biodegradable Systems in Tissue Engineering and Regenerative Medicine*, (Reis et al., eds.) (CRS Press LLC, Boca Raton, 2005) pp. 377-397.
Marquina et al., "Inhibition of B cell death causes the development of an IgA nephropathy in (New Zealand White x C57BL/6)F1-bcl-2 transgenic mice," *J. Immunol.*, 172(11): 7177-7185 (2004).
Martin, A.C.R., "Protein Sequence and Structure Analysis of Antibody Variable Domains," Chapter 31, In *Antibody Engineering*. (Kontermann and Dübel, eds. ), (Springer-Verlag, Berlin, 2001), pp. 422-439.
Marvin and Zhu, "Recombinant approaches to IgG-like bispecific antibodies," *Acta Pharmacologica Sinica*, 26(6): 649-658 (2005).
Masliah et al., "Effects of α-Synuclein Immunization in a Mouse Model of Parkinson's Disease," *Neuron*, 46: 857-868 (2005).
Mateo et al., "Humanization of a mouse monoclonal antibody that blocks the epidermal growth factor receptor: recovery of antagonistic activity," *Immunotechnology*, 3: 71-81 (1997).
McCafferty et al., "Phage antibodies: Filamentous phage displaying antibody variable domains," *Nature*, 348: 552-554 (1990).
McDonnell et al., "TNF Antagonism," In *New Drugs for Asthma, Allergy and COPD. Prog Respir Res.*, vol. 31. (Hansel et al., eds.) (Karger, Basel, 2001) pp. 247-250.

McGee et al., "The Nogo-66 receptor: Focusing myelin inhibition of axon regeneration," *Trends in Neurosciences*, 26(4): 193-198 (2003).
McIntosh et al., "In Vivo Induction of IL-6 by Administration of Exogenous Cytokines and Detection of De Novo Serum Levels of IL-6 in Tumor-Bearing Mice," *J. Immunol.*, 143(1): 162-167 (1989).
McMahon et al., "Does Anti-TNF-Alpha Have a Role in the Treatment of Osteoporosis?" *Bulletin of the NYU Hospital for Joint Diseases*, 66: 280-281 (2008).
Mendez et al., "Functional transplant of megabase human immunoglobulin loci recapitulates human antibody response in mice," *Nature Genet.*, 15: 146-156 (1997).
Merchant et al., "An efficient route to human bispecific IgG," *Nature Biotechnol.*, 16: 677-681 (1998).
Michaelson, J., "Dual Targeting of TNF and TWEAK in Inflammatory Bowel Disease: The Promise of a Bispecific Antibody," Conference, Cytokines & Inflammation, Jan. 28, 2011; Agenda, p. 11. Retrieved from the Internet: http://www.cytokinesandinflammation.com/Index.php?option=com_content&view=article&id=50 &itemid=54.
Miller et al., "Design, Construction, and In Vitro Analyses of Multivalent Antibodies," *J. Immunol.*, 170: 4854-4861 (2003).
Milstein et al., "Hybrid hybridomas and their use in immunohistochemistry:" *Nature*, 305: 537-540 (1983).
Mizushima et al., "pEF-BOS, a powerful mammalian expression vector," *Nucl. Acids Res.*, 18(17): 5322 (1990).
Mnich et al., "Characterization of a monoclonal antibody that neutralizes the activity of prostaglandin $E_2$," *J. Immunol.*, 155: 4437-4444 (1995).
Modjtahedi et al., "Antitumor Activity of Combinations of Antibodies Directed Against Different Epitopes on the Extracellular Domain of the Human EGF Receptor," *Cell Blophys.*, 22(1-3): 129-146 (1993).
Modjtahedi et al., "Phase I trial and tumour localisation of the anti-EGFR monoclonal antibody 1CR62 in head and neck or lung cancer," *Br. J. Cancer*, 73: 228-235 (1996).
Modjtahedi et al., "Targeting of Cells Expressing Wild-Type EGFR and Type-III Mutant EGFR (EGFRVIII) by Anti-EGFR MAB ICR62: A Two-Pronged Attack for Tumour Therapy," *Int. J. Cancer*, 105: 273-280 (2003).
Modjtahedi et al., "The human EGF receptor as a target for cancer therapy: Six new rat mAbs against the receptor on the breast carcinoma MDA-MB 468" *Br. J. Cancer*, 67: 247-253 (1993).
Moreland et al., "Soluble tumor necrosis factor receptors (sTNFR): Results of phase I dose-escalation study in patients with rheumatoid arthritis," (Abstract No. 813), *Arthritis Rheum.*, 37: S295 (1994) (1 page).
Morgan and Anderson, "Human Gene Therapy," *Ann. Rev, Biochem.*, 62: 191-217 (1993).
Moriuchi et al., "Treatment of established collagen-induced arthritis with PGE1 incorporated in lipid microspheres," (Abstract No. 1528), *Arthritis Rheum.*, 39(9 Suppl.): S282 (1996) (1 page).
Morrison and Schlom, "Recombinant Chimeric Monoclonal Antibodies," Chapter 1, In *Important Advances in Oncology 1990* (J.B. Lippincott Company, Philadelphia, 1990), pp. 3-18.
Morrison et al., "Genetically Engineered Antibody Molecules," *Advances in Immunology*, 44:65-925 (1989).
Morrison, S., "Tow heads are better than one," *Nature Biotech.*, 25(11): 1233-1234 (2007).
Müller et al., "The first constant domain ($C_H 1$ and $C_L$) of an antibody used as heterodimerrization domain for bispecific miniantibodies," *FEBS Lett.*, 422: 259-264 (1996).
Mulligan, R.C., "The Basic Science of Gene Therapy," *Science*, 260: 926-932 (1993).
Mullinax et al., "Expression of a Heterodimeric Fab Antibody Protein in One Cloning Step," *BioTechniques*, 12(6): 864-869 (1992).
Murthy et al., "Binding of an Antagonistic Monoclonal Antibody to an Intact and Fragmented EGF-Receptor Polypeptide," *Arch. Biochem. Biophys.*, 252(2):549-560 (1987).
Nakanishi et al., "Interleukin-18 Regulates Both TH1 and TH2 Responses," *Ann. Rev. Immunol.*, 19: 423-474.

(56) References Cited

OTHER PUBLICATIONS

National Center for Biotechnology Information (NCBI), Protein Database, "Chain H, Vascular Endothelial Growth Factor in Complex with a Neutralizing Antibody," Accession No. 1BJ1_H, ROD Jun. 30, 1998 [online]. Retrieved from the Internet: http://www.ncbi.nim.nih.gov/protein/1BJ1_H (3 pages).
National Center for Biotechnology Information (NCBI), Protein Database, "Chain L, Vascular Endothelial Growth Factor in Complex with a Neutralizing Antibody," Accession No. 1BJ1_L, ROD Jun. 30, 1998 [online]. Retrieved from the Internet: http://www.ncbi.nlm.nih.gov/protein/4389276?sat=11&satkey=3623907 (3 pages).
National Center for Biotechnology Information (NCBI), Protein Database, "Chain H, Structure of the G6 Fab, a Phage Derived Vegf Binding Fab," Accession No. 2FJF_H, PRI Jan. 2, 2005 [online]. Retrieved from the Internet: http://www.ncbi.nlm.nih.gov/protein/60109456?sat=34&satkey=11061854 (2 pages).
National Center for Biotechnology Information (NCBI), Protein Database, "Chain L, Structure of the G6 Fab, a Phage Derived Vegf Binding Fab," Accession No. 2FJF_L, PRI Jan. 2, 2006 [online]. Retrieved from the Internet: http://www.ncbi.nlm.nih.gov/protein/90109455?sat=34&satkey=11016154 (2 pages).
National Center for Biotechnology Information (NCBI), Protein Database, "Chain H, Structure of the B20-4 Fab, a Phage Derived Fab Fragment, in complex with Vegf," Accession No. 2FJH_H, PRI Jan. 2, 2005 [online]. Retrieved from the Internet: http://www.ncbi.nlm./nih/ gov/protein/90109487?sat=34&satkey=11061856 (2 pages).
National Center for Biotechnology Information (NCBI), Protein Database, "Chain L, Structure of the B20-4 Fab, a Phage Derived Fab Fragment, in complex with Vegf," Accession No. 2FJH_L, PRI, Jan. 2, 2006 [online]. Retrieved from the Internet: http://www.ncbi.nlm.hih/gov/protein/90109486?sat=34&satkey−11061856 (2 pages).
Nelson, R.B. "The Dualistic Nature of Immune Modulation in Alzheimer's Disease: Lessons from the Transgenic Models," *Curr. Pharm. Des.*, 11: 3335-3352 (2005).
Ning et al., "Intratumoral radioimmunotherapy of a human colon cancer xenograft using a sustained-release gel," *Radiotherapy Oncol.*, 39: 179-189 (1996).
Nishimoto et al., "Treatment of rheumatoid arthritis with humanized anti-interleukin-6 receptor antibody," *Arthritis Rheum.*, 50(60): 1761-1769 (2004).
O'Connor et al., "Requirement of multiple phage displayed peptide libraries for optimal mapping of a conformational antibody epitope on CCR5," *J. Immunol. Methods*, 299: 21-35 (2005).
Okamoto et al., "Rituximab for Rheumatoid Arthritis," *N. Engl. J. Med.*, 351: 1909 (2004) (1 page).
Owens et al., "The Immunology of Multiple Sclerosis and Its Animal Model, Experimental Allergic Encephalomyelitis," *Neurol. Clin.*, 13(1): 51-73 (1995).
Pack and Plückthun, "Miniantibodies: Use of Amphipathic Helices to Produce Functional, Flexibly Linked Dimeric Fv Fragments with High Avidity in *Escherichia coli*," *Biochemistry*, 31: 1579-1584 (1992).
Padlan et al., "IL-13 Regulates the Immune Response to Inhaled Antigens." *J. Immunol.*, 174(12): 8097-8105 (2005).
Padlan et al., "Identification of specificity-determining residues in antibodies," *FASEB J.*, 9: 133-139 (1995).
Padlan, E.A., "A Possible Procedure for Reducing the Immunogenicity of Antibody Variable Domains While Preserving Their Ligand-Binding Properties," *Mol. Immunol.*, 28(3/5): 489-198 (1991).
Park et al., "Generation and characterization of a novel tetravalent bispecific antibody that binds to hepatitis B virus surface antigens," *Molecular Immunol.*, 37: 1123-11320 (2000).
Pearlman and Nguyen, "Analysis of protein drugs," Chapter 6, In *Peptide and Protein Drug Delivery, Advances in Parenteral Sciences*, vol. 4. 1st ed. (Lee, ed.) (Marcel Dekker, Inc., New York, 1991), pp. 247-301.
Peipp et al., "Bispecific antibodies targeting cancer cells," *Biochem. Soc. Trans.*, 30(4): 507-511 (2002).
Peng et al., "Experimental Use of Murine Lupus Models," *Methods Mol. Med.*, 102: 227-272 (2004).
Persic et al., "An integrated vector system for the eukaryotic expression of antibodies or their fragments after seletion from phage display libraries," *Gene*, 187: 9-18 (1997).
Petkova et al., "Enhanced half-life of genetically engineered human IgG1 antibodies in a humanized FcRn mouse model: Potential application in humorlily mediated autoimmune disease," *Int. Immunol.*, 18: 1759-1769 (2006).
Petrey et al., "Using multiple structure alignments, fast model building, and energetic analysis in fold recognition and homology modeling," *Proteins*, 53: 430-435 (2003).
Pham, V. et al., "De nova proteomic sequencing of a monoclonal antibody raised against OX40 ligand," *Analytical Biochemistry*, 352: 77-86 (2006).
Piatesi et al., "Immunological Optimization of a Generic Hydrophobic Pocket for High Affinity Hapten Binding and Diels-Alder Activity," *ChemBioChem*, 5: 460-466 (2004).
Pimm et al., "A bispecific monoclonal antibody against methotrexate and a human tumour associated antigen augments cytotoxicity of methotrexate-carrier conjugate," *Br. J. Cancer*, 61: 508-513 (1990).
Plückthun et al., "New protein engineering approaches to multivalent and bispecific antibody fragments," *Immunotechnology*, 3: 83-105 (1997).
Polak, R.J., "Production and structure of diabodies," *Structure*, 2: 1121-1123 (1994).
Portanova et al., "Selective Neutralization of Prostagilandin $E_2$ Blocks Inflammation, Hyperalgesia, and Interleukin 6 Production In Vivo," *J. Exp. Med.*, 184(3): 883-891 (1996).
Portolano et al., "Lack of promiscuity in autoantigen-specific H and L chain combinations as revealed by human H and L chain 'roulette,'" *J. Immunol.*, 150:880-887 (1993).
Presta et al., "Humanization of an Antibody Directed Against IgE," *Immunol.*, 151(5): 2623-2632 (1993).
Presta, L.G., "Engineering of therapeutic antibodies to minimize immunogenicity and optimize function," *Adv. Drug. Del. Rev.*, 58: 640-656 (2006).
Presta, L.G., "Molecular engineering and design of therapeutic antibodies," *Curr. Opin. Immunol.*, 20: 460-470 (2008).
Presta, L.G., "Selection, design, and engineering of therapeutic antibodies," *J. Allergy Clin. Immunol.*, 116: 731-736 (2005).
Qu et al., "Bispecific anti-CD20/22 antibodies inhibit B-cell lymphoma proliferation by a unique mechanism of action," *Blood*, 111(4): 2211-2219 (2007).
Remington: *The Science and Practice of Pharmacy*. 21st ed.(Lippincott Williams & Wilkins, Philadelphia, 2005), pp. 745-747, 802-804, 838, 879-883, 889-890, and 1079-1082 (14 pages).
Reusch et al., "Anti-CD3 x Anti-Epidermal Growth Factor Receptor (EGFR) Bispecific Antibody Redirects T Cell Cytolytic Activity to EGFR-Positive Cancers In vitro and in an Animal Model," *Clin. Cancer Res.*, 12(1): 183-190 (2006).
Ridgway et al., "'Knobs-into-holes' engineering of antibody $C_H3$ domains for heavy chain heterodimerization," *Protein Eng.*, 9(7): 617-621 (1996).
Riechmann et al., "Reshaping human antibodies for therapy," *Nature*, 332: 323-327 (1988).
Riemer et al., "Matching of trastuzumab (Herceptin®) epitope mimics onto the surface of Her-2/neu—a new method of epitope definition" *Mol. Immunol.*, 42: 1121-1124 (2005).
Roberts et al., "RNA-peptide fusions for the in vitro selection of peptides and proteins," *Proc. Natl. Acad. Sci. USA*, 94: 12297-12302 (1997).
Robinson, C., "Gene therapy—proceedings from laboratory to clinic," *Trends Biotechnol.*, 11(5): 155 (1993) (1 page).
Rodeck et al., "Interations Between Growth Factor Receptors and Corresponding Monoclonal Antibodies in Human Tumors," *J. Cell Biochem.*, 35: 315-320 (1987).
Roguska et al., "A comparison of murine monoclonal antibodies humanized by CDR-grafting and variable domain resurfacing," *Protein Eng.*, 9(10): 895-904 (1996).

(56) References Cited

OTHER PUBLICATIONS

Roguska et al., "Humanization of murine monoclonal antibodies through variable domain resurfacing," *Proc. Natl. Acad. Sci. USA*, 91: 969-973 (1994).
Ronday et al., "Tranexamic acid (TEA), an inhibitor of plasminogen activation, reduces collagen crosslink excretion in arthritis," (Abstract No. 1541), *Arthritis Rheum.*, 39(9 Suppl.): S284 (1996) (1 page).
Ross, J.M., "Sulfasalazine (SSZ) toxicity: An assessment of American College of Rheumatology (ACR) monitoring guidelines for SSZ," (Abstract No. 1520), *Arthritis Rheum.*, 39(9 Suppl.): S281 (1996) (1 page).
Rudikoff et al., "Single amino acid substitution altering antigen binding specificity," *Proc. Natl. Acad. Sci. USA*, 79: 1979-1963 (1982).
Sambrook and Russell (eds.), *Molecular Cloning: A Laboratory Manual.* 3$^{rd}$ Ed. Cold Spring Harbor Laboratory Press, Cold Spring Harbor, NY, 2001; pp. 1.10-1.15, 1.84-1.87, 8.18-8.24, 15.54-15.59, and 16.47-6.55 (18 pages).
Santos et al., "Generation and Characterization of a Single Gene-encoded Single-Chain-Tetravalent Antitumor Antibody," *Clin. Cancer Res.*, 5 (Suppl.): 3118s-3123s (1999).
Satoh et al., "Non-fucosylated therapeutic antibodies as next-generation therapeutic antibodies," *Expert Opin. Biol. Ther.*, 6(11): 1161-1173 (2006).
Saudek et al., "A Preliminary Trial of the Programmable Implantable Medication System for Insulin Delivery," *N. Engl. J. Med.*, 321: 574-579 (1989).
Sawai et al., "Direct Production of the Fab Fragment Derived From the Sperm Immobilizing Antibody Using Polymerase Chain Reaction and cDNA Expression Vectors," *Am. J. Reprod. Immunol.*, 34: 26-34 (1995).
Schier et al., "Identification of functional and structural amino-acid residues by parsimonious mutagenesis," *Gene*, 169: 147-155 (1995).
Scholz, P., "Inhibition of the production and effect of TNF-alpha by iloprost: possible impact for treatment of rheumatoid arthritis," (Abstract No. 335), *Arthritis Rheum.*, 39(9 Suppl.): S82 (1996).
Sefton, M.V., "Implantable Pumps," *CRC Crit. Rev. Biomed. Eng.*, 14(3): 201-240 (1987).
Seligmann et al., "Immunochemical Study of a Human Myeloma IgG1 Half Molecule," *Ann. Immunol.*, 129 C: 855-870 (1978).
Sewell et al., "DAB$_{486}$IL-2 fusion toxin in refractory rheumatoid arthritis," *Arthritis Rheum.*, 36(9): 1223-1233 (Sep. 1993).
Sfikakis et al., "Rituximab anti-B-cell therapy in systemic lupus erythematosus: Pointing to the future," *Curr. Opin. Rheumatol*, 17: 550-557 (2005).
Shalaby et al., "Development of Humanized Bispecific Antibodies Reactive with Cytotoxic Lymphocytes and Tumor Cells Overexpressing the HER2 Protooncogene," *J. Exp. Med.*, 175: 217-225 (1992).
Shapiro et al., "DNA Target Motifs of Somatic Mutagenesis in Antibody Genes," *Crit. Rev. Immunol.*, 22(3): 183-200 (2002).
Shepherd et al., "Novel 'inflammatory plaque' pathology in presenilin-1 Alzheimer's disease," *Neuropathol. Appl., Neurobiol.*, 31: 503-511 (2005).
Shields et al., "Lack of Fucose on Human IgG1 N-Linked Oligosaccharide Improves Binding to Human FcγRIII and Antibody-dependent Cellular Toxicity," *J. Biol. Chem.*, 277(30): 26733-26740 (2002).
Shu et al., "Secretion of a single-gene-encoded immunoglobulin from myeloma cells," *Proc. Natl. Acad. Sci USA*, 90: 7995-7999 (1993).
Sims et al., "A Humanized CD18 Antibody Can Block Function without Cell Destruction," *J. Immunol.*, 151(4): 2296-2308 (1993).
Skerra et al., "Assembly of a Functional Immunoglobulin F$_v$Fragment in *Escherichia coli,*" *Science*, 240: 1038-1041 (1988).
Smith and Morrison, "Recombinant Polymeric IgG: An Approach to Engineering More Potent Antibodies," *Bio/Technology*, 12: 633-688 (1994).
Snibson et al., "Airway remodeling and inflammation in sheep lungs after chronic airway challenge with house dust mite," *Clin. Exp. Allergy*, 35: 146-152 (2005).
Soloman, B., "Alzheimer's Disease and Immunotherapy," *Curr. Alzheimer. Res.*, 1: 149-163 (2004.
Song et al., "Antibody Mediated Lung Targeting of Long-Circulating Emulsions," *PDA J. Pharm. Sci. Technol.*, 50: 372-377 (1996).
Staerz et al., "Hybrid antibodies can target sites for attack by T cells," *Nature*, 314: 628-631 (1985).
Stamper et al., "Crystal structure of the B7-1/CTLA-4 complex that inhibits human immune responses," *Nature*, 410: 608-611 (2001).
Stancovski et al., "Mechanistic aspects of the opposing effects of monoclonal antibodies to the ERBB2 receptor on tumor growth," *Proc. Natl. Acad. Sci. USA*, 88: 8691-8695 (1991).
Steffen et al., "Basic studies on enzyme therapy of immune complex diseases" *Wien Klin. Wochenschr.*, 97(8): 376-385 (1985) (Abstract only) (1 page).
Steinman et al., "Virtues and pitfalls of EAE for the development of therapies for multiple sclerosis," *Trends Immunol.*, 26(11): 565-571 (2005).
Stickler et al., "CD4+ T-cell epitope determination using unexposed human donor peripheral blood mononuclear cells," *J. Immunotherapy*, 23: 654-660 (2000).
Stolk et al., "Are severe non-hematologic side-effects on azathioprine treatment caused by altered purine enzyme activities?" (Abstract No. 1522), *Arthritis Rheum.*, 39(9 Suppl.): (1996) (1 page).
Streppel et al., "Focal application of neutralizing antibodies to soluble neurotrophic factors reduces collateral axonal branching after peripheral nerve lesion," *Eur. J. Neurosci.*, 15(8): 1327-1342 (2002).
Studnicka et al., "Human-engineered monoclonal antibodies retain full specific binding activity by preserving non-CDR complementarity-modulating residues," *Protein Eng.*, 7(6): 805-814 (1994).
Taiwan Patent Application No. 095130565: Taiwan Patent Office Search Report, dated Apr. 24, 2009.
Taylor et al., "A transgenic mouse that expresses a diversity of human sequence heavy and light chain immunoglobulins," *Nucl. Acids Res.*, 20: 6287-6295 (1992).
Teng et al., "Nogo Signaling and Non-Physical Injury-Induced Nervous System Pathology," *J. Neuroscience Research*, 79: 273-278 (2005).
Thies et al., "Folding and Association of the Antibody Domain C$_H$3: Prolyl Isomerization Preceds Dimerization," *J. Mol. Biol.*, 293: 67-79 (1999).
Thoss et al., "Immunomodulation of rat antigen-induced arthritis by leflunomide alone and in combination with cyclosporin A," *Inflamm. Res.*, 45: 103-107 (1996).
Tol et al., "Chemotheray, Bevacizumab, and Cetuximab in Metastatic Colorectal Cancer," *N. Engl. J. Med.*, 360(6): 563-572 (2009).
Tolstoshev, P., "Gene Therapy, Concepts, Current Trials and Future Directions," *Ann. Rev. Pharmacol. Toxicol.*, 32: 573-596 (1993).
Tuohy et al., "Spontaneous Regression of Primary Autoreactivity during Chronic Progression of Experimental Autoimmune Encephalomyelitis and Multiple Sclerosis," *J. Exp. Med.*, 189(7): 1033-1042 (1999).
Umaña et al., "Engineered glycoforms of an antineuroblastoma IgG1 with optimized antibody-dependent cellular cytotoxic activity," *Nature Biotechnol.*, 17: 16-180 (1999).
Urlaub et al., "Isolation of Chinese hamster cell mutants deficient in dihydrofolate reductase activity," *Proc. Natl. Acad. Sci. USA*, 77: 4216-4220 (1980).
U.S. Appl. No. 12/431,460, filed Apr. 28, 2009 by Ghayur et al.: Non-Final Office Action, Mar. 16, 2011.
U.S. Appl. No. 12/431,460, filed Apr. 28, 2009 by Ghayur et al.: Final Office Action, Nov. 2, 2011.
U.S. Appl. No. 12/477,668, filed Jun. 3, 2009 by Ghayur et al.: Non-Final Office Action, Sep. 8, 2011.
U.S. Appl. No. 12/477,668, filed Jun. 3, 2009 by Ghayur et al.: Final Office Action, May 3, 2012.
U.S. Appl. No. 12/477,711, filed Jun. 3, 2009 by Ghayur et al.: Non-Final Office Action, Aug. 11, 2011.

(56) References Cited

OTHER PUBLICATIONS

U.S. Appl. No. 12/477,711, filed Jun. 3, 2009 by Ghayur et al.: Final Office Action, Dec. 30, 2011.
U.S. Appl. No. 12/499,652, filed Jul. 8, 2009 by Ghayur et al.: Non-Final Office Action, May 10, 2011.
U.S. Appl. No. 12/499,652, filed Jul. 8, 2009 by Ghayur et al.: Final Office Action, Nov. 3, 2011.
U.S. Appl. No. 12/605,094, filed Oct. 23, 2009 by Ghayur et al.: Non-Final Office Action, Jun. 2011.
U.S. Appl. No. 12/605,094, filed Oct. 23, 2009 by Ghayur et al.: Final Office Action, Nov. 2011.
U.S. Appl. No. 12/631,483, filed Dec. 4, 2009 by Jakob et al.: Non-Final Office Action, Nov. 23, 2011.
U.S. Appl. No. 12/631,483, filed Dec. 4, 2009 by Jakob et al.: Final Office Action, Jul. 6, 2012.
U.S. Appl. No. 12/771,871, filed Apr. 30, 2010 by Ghayur et al.: Non-Final Office Action, May 16, 2012.
U.S. Appl. No. 12/771,874, filed Apr. 30, 2010 by Ghayur at al.: Non-Final Office Action, Sep. 7, 2012.
U.S. Appl. No. 12/771,874, filed Apr. 30, 2010 by Ghayur et al.: Non-Final Office Action, Apr. 18, 2013.
U.S. Appl. No. 12/771,874, filed Apr. 30, 2010 by Ghayur et al.: Final Office Action, Nov. 12, 2013.
U.S. Appl. No. 12/873,926, filed Sep. 1, 2010 by Ghayur et al.: Non-Final Office Action, Aug. 28, 2012.
U.S. Appl. No. 12/873,926, filed Sep. 1, 2010 by Ghayur et al.: Final Office Action, Mar. 12, 2013.
U.S. Appl. No. 12/905,474, filed Oct. 15, 2010 by Ghayur et al: Non-Final Office Action, May 29, 2013.
U.S. Appl. No. 13/167,313, filed Jun. 23, 2011 by Ghayur et al.: Non-Final Office Action, Jun. 4, 2013.
U.S. Appl. No. 13/167.333, filed Jun. 23, 2011 by Ghayur et al.: Final Office Action, Nov. 20, 2013.
U.S. Appl. No. 13/196,138, filed Aug. 2, 2011 by Ghayur et al.: Non-Final Office Action, Nov. 27, 2012.
U.S. Appl. No. 13/217,937, filed Aug. 25, 2011 by Ghayur et al.: Non-Final Office Action, Sep. 6, 2012.
U.S. Appl. No. 13/217,937, filed Aug. 25, 2011 by Ghayur at al.: Final Office Action, Mar. 20, 2013.
U.S. Appl. No. 13/286,707, filed Nov. 1, 2011 by Ghayur et al.: Non-Final Office Action, Feb. 25, 2013.
U.S. Appl. No. 13/286,707, filed Nov. 1, 2011 by Ghayur et al.: Final Office Action, Jul. 17, 2013.
Vaccaro et al., "Divergent activities of an engineered antibody in murine and human systems have implications for therapeutic antibodies." *Proc. Natl. Acad. Sci. USA*, 103:18709-18717 (2006).
Vajdos et al., "Comprehensive functional maps of the antigen-binding site of an anti-Erb32 antibody obtained with shotgun scanning mutagenesis," *J. Mol. Biol.*, 320: 415-428 (2002).
Verhoeyen et al., "Reshaping Human Antibodies: Grafting an Antilysozyme Activity," *Science*, 239: 1534-1536 (1988).
Voet et al. (Eds.), *Biochemistry*, John Wiley & Sons, Inc., 1999; p. 1100.
Voller et al., "Enzyme immunoassays with special reference to ELISA techniques," *J. Clin. Pathol.*, 31:507-520 (1978).
Von Mehren et al., "Monoclonal Antibody Therapy for Cancer," *Ann. Rev. Med.*, 54: 343-369 (2003).
Wallick et al., "Glycosylation of a $V_H$ Residue of a Monocional Antibody Against α(1→6) Dextran Increases Its Affinity for Antigen," *J. Exp. Med.*, 168: 1099-1109 (1988).
Wang et al., "Antibody Structure, Instability, and Formulation," *J. Pharm. Sci.*, 96(1): 1-26 (2007).
Ward et al., "Binding activities of a repertoire of single immunoglobulin variable domains secreted from *Escheria coli,*" *Nature*, 341: 544-546 (1989).
West Jr. et al., "Crystal Structure and Immunoglobulin G Binding Properties of the Human Major Histocompatibility Complex-Related Fc Receptor," *Biochemistry*, 39: 9698-9708 (2000).
Wileman et al., "Association between Subunit Ectodomains Promote T Cell Antigen Receptor Assembly and Protect against Degradation in the ER," *J. Cell Biol.*, 122(1): 67-78 (1993).
Wing et al., "Ex-vivo whole blood cultures for predicting cytokine-release syndrome: Dependence on target antigen and antibody isotype," *Therapeutic Immunol.*, 2(4): 183-190 (1995).
Winkles, J., "The TWEAK-Fn14 cytokine-receptor axis: discovery, biology and therapeutic targeting," *Nature Reviews. Drug Disc.*, 7(5):411-425 (2008).
Wooldridge et al., "Tricks with tetramers: How to get the most from multimeric peptide-MHC," *Immunology*, 126: 147-184 (2009).
Wright et al., "Antibody variable region glycosylation: Position effects on antigen binding and carbohydrate structure," *EMBO J.*, 10(10): 2717-2723 (1991).
Wu and Grainger, "Drug/device combinations for local drug therapies and infection prophylaxis," *Biomaterials*, 27: 2450-2467 (2006).
Wu and Wu, "Delivery systems for gene therapy," *Biotherapy*, 3: 87-95 (1991).
Wu and Wu, "Receptor-mediated in Vitro Gene Transformation by a Soluble DNA Carrier System," *J. Biol. Chem.*, 262(10): 4429-4432 (1987).
Wu et al., "Humanization of a murine monoclonal antibody by simultaneous optimization of framework and CDR residues," *J. Mol. Biol.*, 294: 151-162 (1999).
Wu et al., "IL-18 receptor β-induced changes in the presentation of IL-18 binding sites affect ligand binding and signal transduction," *J. Immunol.*, 170: 5571-5577 (2003).
Wu et al., "Simultaneous targeting of multiple disease mediators by a dual-variable-domain immunoglobulin," *Nature Biotechnol.*, 25(11): 1290-1297 (2007).
Wu et al., "Simultaneous targeting of multiple disease mediators by a dual-variable-domain immunoglobulin," *Nature Biotechnology* (advance online publication, http://www.nature.com/naturebiotechnology), pp. 1-8 (published online Oct. 14, 2007).
Wu et al., "Tumor localization of anti-CEA single-chain Fvs: Improved targeting by non-covalent dimers," *Immunotechnology*, 2(1): 21-36 (1996).
Wu et al., "Molecular construction and optimization of anti-human IL-1α/β dual variable domain immunoglobulin (DVD-Ig™) molecules," *mAbs*, 1(4): 339-347 (2009).
Wu et al., "Generation and Characterization of a Dual Variable Domain Immunoglobulin (DVD-Ig™) Molecule " in *Antibody Engineering*, vol. 2. R. Kontermann and S. Dübel (Eds.), Springer-Verlag, 2010, pp. 239-250.
Wurm, F.M., "Production of recombinant protein therapeutics in cultivated mammalian cells," *Nature Biotechnol.*, 22(11): 1393-1398 (2004).
Xu et al., "Recombinant DNA vaccine encoding multiple domains related to inhibition of neurite outgrowth: A potential strategy for axonal regeneration," *J. Neurochem.*, 91: 1018-1023 (2004).
Yelton et al., "Affinity Maturation of the BR96 Anti-Carcinoma Antibody by Codon-Based Mutagenesis," *J. Immunol.*, 155: 1994-2004 (1995).
Yonehara et al., "Involvement of apoptosis antigen Fas in clonal deletion of human thymocytes," *Int. Immunol.*, 6(12); 1849-1856 (1994).
Zapata et al., "Engineering linear F(ab')$_2$ fragments for efficient production in *Escherichia coli* and enhanced antiproliferative activity,"*Protein Eng.*, 8(10): 1057-1062 (1995).
Zhang et al., "Inhibition of Cyclooxygenase-2 Rapidly Reverses Inflammatory Hyperalgesia and Prostaglandin $E_2$ Production," *J. Pharmacol. Exp. Ther.*, 283(3): 1069-1075 (1997).
Zola et al., "CD Molecules 2005: Human cell differentiation molecules," *Blood*, 106: 3123-3126 (2005).
Zuo et al., "An efficient route to the production of an IgG-like bispecific antibody," *Protein Eng.*, 13(5): 361-367 (2000).
Ahmed et al., "Pharmacokinetics of ABT-122, a Dual TNF- and IL-17A-Targeted DVD-IG™, After Single Dosing in Healthy Volunteers and Multiple Dosing in Subjects with Rheumatoid Arthritis," *Ann. Rheum. Dis.*, 74(Suppl. 2):479, Abstract FRI0156 (2015).

(56) References Cited

OTHER PUBLICATIONS

Atwell et al., "Stable heterodimers from remodeling the domain interface of a homodimer using a phage display library," *J. Mol. Biol.*, 270: 26-35 (1997).
Bergman et al. "Pharmacokinetics of IgG and IgM anti-ganglioside antibodies in rats and monkeys after intrathecal administration" *J. Pharmacol. Exp. Ther.*, 284(1): 111-115 (1998).
Braen et al., "A 4-week intrathecal toxicity and pharmacokinetic study with trastuzumab in cynomolgus monkeys." *Int. J. Toxicol.*, 29(3): 259-267 (2010).
Coloma et al., "Transport across the primate blood-brain barrier of a genetically engineered chimeric monoclonal antibody to the human insulin receptor," *Pharm. Res.*, 17(3): 266-274 (2000).
Cooper et al., "Variable domain-identical antibodies exhibit IgG subclass-related differences in affinity and kinetic constants as determined by surface plasmon resonance " *Mol. Immunol.*, 31(8): 577-584 (Jun. 1994).
European Patent Application No. 11838670.5: Supplementary European Search Report and Opinion, dated 2015 (10 pages).
European Patent Application No. 11838670.5: Supplementary European Search Report and Opinion, dated Oct. 13, 2015 (19 pages).
European Patent Application No. 15153941.8 by AbbVie Inc.: Extended European Search Report and Opinion, dated Jun. 10, 2015 (89 pages).
European Patent Application No. 15162013.5 by AbbVie Inc.: Extended European Search Report, including Search Opinion, dated Nov. 10, 2015 (12 pages).
European Patend Application No. 15162013.5 by AbbVie Inc.: Partial European Search Report, dated Jul. 17, 2015 (8 pages).
European Patent Application No. 15162064.8 by AbbVie Inc.: European Search Report, dated Oct. 9, 2015 (15 pages).
European Patent Application No. 15162064.8 by AbbVie Inc.: Partial European Search Report, dated Jul. 10, 2015 (8 pages).
European Patent Application No. 15189272.6 by AbbVie Inc.: Extended European Search Report, including Search Opinion, dated Feb. 16, 2016 (8 pages).
Fiala et al., "IL-17A is increased in the serum and in spinal cord CD8 and mast cells of ALS patients," *J. Neuroinflamm.*, 7:76 (14 pages).
Friden et al., "Anti-transferrin receptor antibody and antibody-drug conjugates cross the blood-brain barrier," *Proc. Natl. Acad. Sci. USA*, 88:4771-4775 (1991).
Garber, K., "Targeting vessel abnormaiization in cancer," *J. Natl. Canc. Inst.*, 99(13): 991-995 (2007).
Garg et al., "Investigation of the influence of FcRn on the distribution of IgG to the brain," *AAPS J.*, 11(3): 553-557 (2009).
Gold and Lühder, "Interleukin-17—Extended Features of a Key Player in Multiple Sclerosis," *Am. J. Pathol.*, 172(1): 8-10 (2008).
Golde et al., "Quantitative and mechanistic studies of Aβ immunotherapy," *CNS Neurol. Disord. Drug Targets*, 8: 31-49 (2009).
Hezareh et al., "Effector Function Activities of a Panel of Mutants of a Broadly Neutralizing Antibody against Human Immunodeficiency Virus Type 1," *J. Virol.*, 75(24); 12161-12168 (Dec. 2001).
Honkanen et al., "IL-17 Immunity in Human Type 1 Diabetes," *J. Immunol.*, 185: 1959-1967 (2010).
Hsieh et al., "Discovery and Characterization of ABT-122, an Anti-TNF/IL-17 DVD-Ig™ Molecule as a Potential Therapeutic Candidate for Rheumatoid Arthritis," *Ann. Rheum. Dis.*, 73(Suppl. 2):495, Abstract FRI0303 (2014).
Inter Partes Reexamination (Control No. 95/001,380) of U.S. Pat. No. 7,612,181 (U.S. Appl. No. 11/507,050): Examiner's Determination on Patent Owner Response/Requester Comments After Board Decision, dated Jun. 2, 2015.
Inter Partes Reexamination (Control No. 95/001,380) of U.S. Pat. No. 7,612,181 (U.S. Appl. No. 11/507,050): Patent Owner's Comments on Examiner's Determination after Board Decision ("Patent Owner's Comments Under 37 C.F.R. § 41.77(e)"), dated Jul. 2, 2015.
Inter Partes Reexamination (Control No. 95/001,380) of U.S. Pat. No. 7,612,181 (U.S. Appl. No. 11/507,050): Requester Comments on Patent Owner Response after Board Decision ("Sanofi's Comments Pursuant to 37 C.F.R, § 41.77(e)"), dated Aug. 2. 2015.
Inter Partes Reexamination (Control No. 95/001,380) of U.S. Pat. No. 7,612,181 (U.S. Appl. No. 11/507,050): Patent Owner's Request for Oral Hearing and Petition Under 37 C.F.R. § 1.183 for Oral Hearing, dated Sep. 4, 2015.
International Patent Application No. PCT/US2013/073114, filed Dec. 4, 2013 by AbbVie, Inc.: International Search Report and Written Opinion, malied Jul. 7, 2014 (24 pages).
International Patent Application No. PCT/US2015/035441, filed Jun. 11, 2015 by AbbVie Inc: Invitation to Pay Additional Fees, with Communication Relating to the Results of the Partial International Search, mailed Oct. 7, 2015 (6 pages).
International Patent Application No. PCT/US2015/035441, filed Jun. 11, 2015 by AbbVie Inc: International Search Report and Written Opinion, mailed Dec. 10, 2015 (18 pages).
Lajoie, S. et al., "Complement-mediated regulation of the IL-17A axis is a central genetic determinant of the severity of experimental allergic asthma," *Nat. Immunol.*, 11(10) 928-935 (Oct. 2010).
Lazarovici et al., "Cross Talk between the Cardiovascular and Nervous Systems: Neurotrophic Effects of Vascular Endothelial Growth Factor (VEGF) and Angiogenic Effects of Nerve Growth Factor (NGF)—Implications in Drug Development," *Curr. Pharmaceut. Des.*, 12:2609-2622 (2006).
Levites et al., "Insights into the mechanisms of action of anti-Aβ antibodies in Alzheimer's disease mouse models," *FASEB J.*, 20(14): 2576-2578 (2006).
Mansikka et al., "Safety, Tolerability, and Functional Activity of ABT-122, a Dual TNF- and IL-17α-Targeted DVD-Ig™, Following Single-Dose Administration in Healthy Subjects," *Ann. Rheum. Dis.*, 74(Suppl. 2):482-483 (2015).
Martin et al., "The Emerging Role of IL-17 in the Pathogenesis of Psoriasis: Preclinical and Clinical Findings," *J. Invest. Dermatol.*, 133: 17-26 (2013).
Metz et al., "Bispecific antibody derivatives with restricted binding functionalities that are activated by proteolytic processing," *Prot. Engin. Des. Sel.*, 25(10): 571-580 (2012).
Onishi and Gaffen, "Interleukin-17 and its target gees: mechanisms of interleukin-17 function in disease," *Immunol.*, 129:311-321 (2010).
Pardridge, "Biologic TNFα- inhibitors that cross the human blood-brain barrier," *Bioengineered Bugs*1(4): 231-234 (2010).
Pardridge, "Blood-brain barrier delivery of protein and non-viral gene therapeutics with molecular Tojan horses," *J. Control Release*, 122(3): 345-348 (2007).
Ridgway et al., "Inhibition of DII4 signaling inhibits tumour growth by deregulating angiogenesis," *Nature*, 144(7122): 1083-1087 (2006).
Romon et al., "Nerve growth factor promotes breast cancer angiogenesis by activating multiple pathway," *Mol. Cancer*, [online] 9:157 (13 pages) (Jun. 2010), Retrieved from the Internet: http://rd.springer.com/content/pdf/10.1186/1476-4598-9-157.pdf; retrieved on Jul. 2, 2015.
Schaefer et al., "Immunoglobulin domain crossover as a generic approach for the production of bispecific IgG antibodies," *PNAS*, 108(27): 11187-11192 (2011).
Selkoe, "Clearing the brain's amyloid cobwebs," *Neuron*, 32(2): 177-180 (2001).
Shen et al., "Principles and applicability of CSF sampling for the assessment of CNS drug delivery and pharmacodynamics," *Adv. Drug Deliv. Rev.*, 56(12): 1825-1857 (2004).
Skripuletz et al., "Cortical demyelination is prominent in the murine cuprizone model and is strain-dependent," *Am. J. Physiol.*, 172(4): 1053-1061 (2008).
Thurston et al., "The Delta paradox; DLL4 blockade leads to more tumour vessels but less tumour growth," *Nat. Rev.: Cancer*, 7(5): 327-331 (2007).
Torres et al., "The Immunoglobulin Heavy Chain Constant Region Affects and Thermodynamic Parameters of Antibody Variable Region Interactions with Antigen," *J. Biol. Chem.*, 282(18): 13917-13927 (May 2007).

(56) References Cited

OTHER PUBLICATIONS

U.S. Appl. No. 12/477,668, filed Jun. 3, 2009 by Ghayur et al.: Notice of Allowance, Apr. 13, 2015.
U.S. Appl. No. 12/477,668, filed Jun. 3, 2009 by Ghayur et al.: Final Office Action, Oct. 14, 2014.
U.S. Appl. No. 13/178,641, filed Jul. 8, 2011 by Ghayur et al.: Notice of Allowance, May 7, 2015.
U.S. Appl. No. 13/286,707, filed Nov. 1, 2011 by Ghayur et al.: Final Office Action, Aug. 29, 2014.
U.S. Appl. No. 13/286,707, filed Nov. 1, 2011 by Ghayuyr et al.: Examiner's Answer to Appeal Brief, Sep. 28, 2015.
U.S. Appl. No. 13/729,353, filed Dec. 28, 2012 by Ghayur et al.: Non-Final Office Action Jun. 2, 2015.
U.S. Appl. No. 13/729,645, filed Dec. 28, 2012 by Hsieh et al.: Notice of Allowance, May 1, 2015.
U.S. Appl. No. 14/068,976, filed Oct. 21, 2013 by Gu et al.: Notice of Allowance, Jun. 11, 2015.
U.S. Appl. No. 14/135,149, filed Dec. 19, 2013, by Ghayur et al.: Non-Final Office Action, Dec. 4, 2015.
U.S. Appl. No. 14/211,604, filed Mar. 14, 2014 by Ghayur et al.: Notice of Allowance, Mar. 26, 2015.
U.S. Appl. No. 14/248,223, filed Apr. 8, 2014 by Ghayur et al.: Non-Final Office Action, Mar, 24, 2015.
U.S. Appl. No. 14/248,223, filed Apr. 8, 2014 by Ghayur et al.: Final Office Action, Jul. 22, 2015.
U.S. Appl. No. 14/301,305, filed Jun. 10, 2014 by Ghayur et al.: Non-Final Office Action, May 29, 2015.
U.S. Appl. No. 14/301,546, filed Jun. 11, 2014 by Gu et al.: Notice of Allowance, Apr. 9, 2015.
U.S. Appl. No. 14/301,546, filed Jun. 11, 2014 by Gu et al.: Non-Final Office Action, Nov. 24, 12014.
U.S. Appl. No. 14/323,627, filed Jul. 3, 2014 by Ghayur et al.: Notice of Allowance, Dec. 8. 2014.
Vincent et al., "Clinical associations of serum interleukin-17 in systemic lupus erythematosus." *Arthritis Res. Ther.*, 15: R97 (9 pages).
Wang, P. and X. Yang, "Neutralization Efficiency is Greatly Enhanced by Bivalent Binding of an Antibody to Epitopes in the V4 Region and the Membrane-Proximal External Region within One Trimer of Human Immunodeficiency Virus Type 1 Glycoproteins" *J. Virol.*, 94(14): 7114-7123 (2010).
Wynn et al., "Distinct roles of IL-13 and IL-17 in chronic inflammation and fibrosis," *J. Immunol.*, 194:134.8 (2010).
Yamada et al., "Aβ Immunotherapy: Intracerebral Sequestration of Aβ by an Anti-Aβ Monoclonal Antibody 266 with High Affinity to Soluble Aβ," *J. Neurosci.*, 29(36):11393-11398 (2009).
Zhang and Pardridge,"Delivery of β-Galactosidase to Mouse Brain via the Boood-Brain Barrier Transferrin Receptor," *J. Pharmacol. Exper. Ther.*, 313(4): 1075-1081 (2005).
Zhou et al., "Neuroprotection with a Brain-Penetrating Biologic Tumor Necrosis Factor Inhibitor," *J. Pharmacol. Exp. Therapeut.*, 339(2): 618-623 (2011).

\* cited by examiner

A

B

DUAL VARIABLE DOMAIN IMMUNOGLOBULINS AND USES THEREOF

CROSS REFERENCE TO RELATED APPLICATIONS

This application is a Divisional of U.S. patent application Ser. No. 13/196,138, filed Aug. 2, 2011, which claims priority to U.S. Provisional Application Nos. 61/377,134, filed Aug. 26, 2010 and 61/370,269, filed Aug. 3, 2010, each of which is incorporated herein by reference in its entirety.

FIELD

Multivalent and multispecific binding proteins that bind IL-1β and IL-17, methods of making, and specifically to their uses in the, diagnosis, prevention and/or treatment of acute and chronic inflammatory diseases, cancer, and other diseases are provided.

BACKGROUND

Engineered proteins, such as multispecific antibodies that bind to two or more antigens are known in the art. Such multispecific binding proteins can be generated using cell fusion, chemical conjugation, or recombinant DNA techniques.

Bispecific antibodies have been produced using quadroma technology (see Milstein, C. and Cuello, A. C. (1983) Nature 305(5934):537-40) based on the somatic fusion of two different hybridoma cell lines expressing murine monoclonal antibodies (mAbs) with the desired specificities of the bispecific antibody. Because of the random pairing of two different immunoglobulin (Ig) heavy and light chains within the resulting hybrid-hybridoma (or quadroma) cell line, up to ten different Ig species are generated, of which only one is the functional bispecific antibody. The presence of mis-paired by-products, and significantly reduced production yields, means sophisticated purification procedures are required.

Bispecific antibodies can also be produced by chemical conjugation of two different mAbs (see Staerz, U. D., et al. (1985) Nature 314(6012): 628-31). This approach does not yield homogeneous preparation. Other approaches have used chemical conjugation of two different mAbs or smaller antibody fragments (see Brennan, M., et al. (1985) Science 229(4708): 81-3).

Another method used to produce bispecific antibodies is the coupling of two parental antibodies with a hetero-bifunctional crosslinker, but the resulting bispecific antibodies suffer from significant molecular heterogeneity because reaction of the crosslinker with the parental antibodies is not site-directed. To obtain more homogeneous preparations of bispecific antibodies two different Fab fragments have been chemically crosslinked at their hinge cysteine residues in a site-directed manner (see Glennie, M. J., et al. (1987) J. Immunol. 139(7): 2367-75). But this method results in Fab'2 fragments, not a full IgG molecule.

A wide variety of other recombinant bispecific antibody formats have been developed (see Kriangkum, J., et al. (2001) Biomol. Engin. 18(2): 31-40). Amongst them tandem single-chain Fv molecules and diabodies, and various derivatives thereof, are the most widely used. Routinely, construction of these molecules starts from two single-chain Fv (scFv) fragments that recognize different antigens (see Economides, A. N., et al. (2003) Nat. Med. 9(1): 47-52). Tandem scFv molecules (taFv) represent a straightforward format simply connecting the two scFv molecules with an additional peptide linker. The two scFv fragments present in these tandem scFv molecules form separate folding entities. Various linkers can be used to connect the two scFv fragments and linkers with a length of up to 63 residues (see Nakanishi, K., et al. (2001) Ann. Rev. Immunol. 19: 423-74). Although the parental scFv fragments can normally be expressed in soluble form in bacteria, it is, however, often observed that tandem scFv molecules form insoluble aggregates in bacteria. Hence, refolding protocols or the use of mammalian expression systems are routinely applied to produce soluble tandem scFv molecules. In a recent study, in vivo expression by transgenic rabbits and cattle of a tandem scFv directed against CD28 and a melanoma-associated proteoglycan was reported (see Gracie, J. A., et al. (1999) J. Clin. Invest. 104(10): 1393-401). In this construct, the two scFv molecules were connected by a CH1 linker and serum concentrations of up to 100 mg/L of the bispecific antibody were found. Various strategies including variations of the domain order or using middle linkers with varying length or flexibility were employed to allow soluble expression in bacteria. A few studies have now reported expression of soluble tandem scFv molecules in bacteria (see Leung, B. P., et al. (2000) J. Immunol. 164(12): 6495-502; Ito, A., et al. (2003) J. Immunol. 170(9): 4802-9; Karni, A., et al. (2002) J. Neuroimmunol. 125(1-2): 134-40) using either a very short Ala3 linker or long glycine/serine-rich linkers. In a recent study, phage display of a tandem scFv repertoire containing randomized middle linkers with a length of 3 or 6 residues was employed to enrich for those molecules that are produced in soluble and active form in bacteria. This approach resulted in the isolation of a tandem scFv molecule with a 6 amino acid residue linker (see Arndt, M. and Krauss, J. (2003) Methods Mol. Biol. 207: 305-21). It is unclear whether this linker sequence represents a general solution to the soluble expression of tandem scFv molecules. Nevertheless, this study demonstrated that phage display of tandem scFv molecules in combination with directed mutagenesis is a powerful tool to enrich for these molecules, which can be expressed in bacteria in an active form.

Bispecific diabodies (Db) utilize the diabody format for expression. Diabodies are produced from scFv fragments by reducing the length of the linker connecting the VH and VL domain to approximately 5 residues (see Peipp, M. and Valerius, T. (2002) Biochem. Soc. Trans. 30(4): 507-11). This reduction of linker size facilitates dimerization of two polypeptide chains by crossover pairing of the VH and VL domains. Bispecific diabodies are produced by expressing, two polypeptide chains with, either the structure VHA-VLB and VHB-VLA (VH-VL configuration), or VLA-VHB and VLB-VHA (VL-VH configuration) within the same cell. A large variety of different bispecific diabodies have been produced in the past and most of them are expressed in soluble form in bacteria. However, a recent comparative study demonstrates that the orientation of the variable domains can influence expression and formation of active binding sites (see Mack, M. et al. (1995) Proc. Natl. Acad. Sci. USA 92(15): 7021-5). Nevertheless, soluble expression in bacteria represents an important advantage over tandem scFv molecules. However, since two different polypeptide chains are expressed within a single cell inactive homodimers can be produced together with active heterodimers. This necessitates the implementation of additional purification steps in order to obtain homogenous preparations of bispecific diabodies. One approach to force the generation of bispecific diabodies is the production of knob-into-hole diabodies (see Holliger, P., et al. (1993) Proc. Natl. Acad.

Sci. USA 90(14): 6444-8.18). This was demonstrated for a bispecific diabody directed against HER2 and CD3. A large knob was introduced in the VH domain by exchanging Val37 with Phe and Leu45 with Trp and a complementary hole was produced in the VL domain by mutating Phe98 to Met and Tyr87 to Ala, either in the anti-HER2 or the anti-CD3 variable domains. By using this approach the production of bispecific diabodies could be increased from 72% by the parental diabody to over 90% by the knob-into-hole diabody. Importantly, production yields did only slightly decrease as a result of these mutations. However, a reduction in antigen-binding activity was observed for several analyzed constructs. Thus, this rather elaborate approach requires the analysis of various constructs in order to identify those mutations that produce heterodimeric molecule with unaltered binding activity. In addition, such approach requires mutational modification of the immunoglobulin sequence at the constant region, thus creating non-native and non-natural form of the antibody sequence, which may result in increased immunogenicity, poor in vivo stability, as well as undesirable pharmacokinetics.

Single-chain diabodies (scDb) represent an alternative strategy for improving the formation of bispecific diabody-like molecules (see Holliger, P. and Winter, G. (1997) Cancer Immunol. Immunother. 45(3-4): 128-30; Wu, A. M., et al. (1996) Immunotechnology 2(1): p. 21-36). Bispecific single-chain diabodies are produced by connecting the two diabody-forming polypeptide chains with an additional middle linker with a length of approximately 15 amino acid residues. Consequently, all molecules with a molecular weight corresponding to monomeric single-chain diabodies (50-60 kDa) are bispecific. Several studies have demonstrated that bispecific single chain diabodies are expressed in bacteria in soluble and active form with the majority of purified molecules present as monomers (see Holliger, P. and Winter, G. (1997) Cancer Immunol. Immunother. 45(3-4): 128-30; Wu, A. M., et al. (1996) Immunotechnol. 2(1): 21-36; Pluckthun, A. and Pack, P. (1997) Immunotechnol. 3(2): 83-105; Ridgway, J. B., et al. (1996) Protein Engin. 9(7): 617-21). Thus, single-chain diabodies combine the advantages of tandem scFvs (all monomers are bispecific) and diabodies (soluble expression in bacteria).

More recently diabodies have been fused to Fc to generate more Ig-like molecules, named di-diabodies (see Lu, D., et al. (2004) J. Biol. Chem. 279(4): 2856-65). In addition, multivalent antibody constructs comprising two Fab repeats in the heavy chain of an IgG and that bind four antigen molecules have been described (see WO 0177342A1, and Miller, K., et al. (2003) J. Immunol. 170(9): 4854-61).

There is a need in the art for improved multivalent binding proteins that bind two or more antigens. U.S. Pat. No. 7,612,181 provides a novel family of binding proteins that bind two or more antigens with high affinity, and which are called dual variable domain immunoglobulins (DVD-Ig™). The present disclosure provides further novel binding proteins that bind two or more antigens.

SUMMARY

Multivalent binding proteins that bind two or more antigens are provided. A novel family of binding proteins capable of binding two or more antigens with high affinity are also provided.

In one embodiment, a binding protein comprising a polypeptide chain, wherein the polypeptide chain comprises VD1-(X1)n-VD2-C—(X2)n, wherein VD1 is a first variable domain, VD2 is a second variable domain, C is a constant domain, X1 represents an amino acid or polypeptide, X2 represents an Fc region and n is 0 or 1 is provided. In an embodiment the VD1 and VD2 in the binding protein are heavy chain variable domains. In another embodiment, the heavy chain variable domain is a murine heavy chain variable domain, a human heavy chain variable domain, a CDR grafted heavy chain variable domain, or a humanized heavy chain variable domain. In yet another, embodiment VD1 and VD2 bind the same antigen. In another embodiment VD1 and VD2 bind different antigens. In still another embodiment, C is a heavy chain constant domain. For example, X1 is a linker with the proviso that X1 is not CH1. For example, X1 is AKTTPKLEEGEFSEAR (SEQ ID NO: 1); AKTTPKLEEGEFSEARV (SEQ ID NO: 2); AKTTPKLGG (SEQ ID NO: 3); SAKTTPKLGG (SEQ ID NO: 4); SAKTTP (SEQ ID NO: 5); RADAAP (SEQ ID NO: 6); RADAAPTVS (SEQ ID NO: 7); RADAAAAGGPGS (SEQ ID NO: 8); RADAAAA(G4S)4 (SEQ ID NO: 9), SAKTTP-KLEEGEFSEARV (SEQ ID NO: 10); ADAAP (SEQ ID NO: 11); ADAAPTVSIFPP (SEQ ID NO: 12); TVAAP (SEQ ID NO: 13); TVAAPSVFIFPP (SEQ ID NO: 14); QPKAAP (SEQ ID NO: 15); QPKAAPSVTLFPP (SEQ ID NO: 16); AKTTPP (SEQ ID NO: 17); AKTTPPSVTPLAP (SEQ ID NO: 18); AKTTAP (SEQ ID NO: 19); AKTTAPSVYPLAP (SEQ ID NO: 20); ASTKGP (SEQ ID NO: 21); ASTKGPSVFPLAP (SEQ ID NO: 22), GGGGSGGGGSGGGGS (SEQ ID NO: 23); GENKVEYA-PALMALS (SEQ ID NO: 24); GPAKELTPLKEAKVS (SEQ ID NO: 25); GHEAAAVMQVQYPAS (SEQ ID NO: 26); TVAAPSVFIFPPTVAAPSVFIFPP (SEQ ID NO: 27); or ASTKGPSVFPLAPASTKGPSVFPLAP (SEQ ID NO: 28). In an embodiment, X2 is an Fc region. In another embodiment, X2 is a variant Fc region.

In an embodiment the binding protein disclosed herein comprises a polypeptide chain, wherein the polypeptide chain comprises VD1-(X1)n-VD2-C—(X2)n, wherein VD1 is a first heavy chain variable domain, VD2 is a second heavy chain variable domain, C is a heavy chain constant domain, X1 is a linker with the proviso that it is not CH1, and X2 is an Fc region.

In an embodiment, VD1 and VD2 in the binding protein are light chain variable domains. In an embodiment, the light chain variable domain is a murine light chain variable domain, a human light chain variable domain, a CDR grafted light chain variable domain, or a humanized light chain variable domain. In one embodiment VD1 and VD2 bind the same antigen. In another embodiment VD1 and VD2 bind different antigens. In an embodiment, C is a light chain constant domain. In another embodiment, X1 is a linker with the proviso that X1 is not CL1. In an embodiment, X1 is AKTTPKLEEGEFSEAR (SEQ ID NO: 1); AKTTPKLEEGEFSEARV (SEQ ID NO: 2); AKTTPKLGG (SEQ ID NO: 3); SAKTTPKLGG (SEQ ID NO: 4); SAK-TTP (SEQ ID NO: 5); RADAAP (SEQ ID NO: 6); RADAAPTVS (SEQ ID NO: 7); RADAAAAGGPGS (SEQ ID NO: 8); RADAAAA(G4S)4 (SEQ ID NO: 9); SAKTTP-KLEEGEFSEARV (SEQ ID NO: 10); ADAAP (SEQ ID NO: 11); ADAAPTVSIFPP (SEQ ID NO: 12); TVAAP (SEQ ID NO: 13); TVAAPSVFIFPP (SEQ ID NO: 14); QPKAAP (SEQ ID NO: 15); QPKAAPSVTLFPP (SEQ ID NO: 16); AKTTPP (SEQ ID NO: 17); AKTTPPSVTPLAP (SEQ ID NO: 18); AKTTAP (SEQ ID NO: 19); AKTTAPS-VYPLAP (SEQ ID NO: 20); ASTKGP (SEQ ID NO: 21); ASTKGPSVFPLAP (SEQ ID NO: 22), GGGGSGGGGSGGGGS (SEQ ID NO: 23); GENKVEYA-PALMALS (SEQ ID NO: 24); GPAKELTPLKEAKVS (SEQ ID NO: 25); GHEAAAVMQVQYPAS (SEQ ID NO:

26); TVAAPSVFIFPPTVAAPSVFIFPP (SEQ ID NO: 27); or ASTKGPSVFPLAPASTKGPSVFPLAP (SEQ ID NO: 28. In an embodiment, the binding protein does not comprise X2.

In an embodiment, both the variable heavy and variable light chain comprise the same linker. In another embodiment, the variable heavy and variable light chain comprise different linkers. In another embodiment, both the variable heavy and variable light chain comprise a short (about 6 amino acids) linker. In another embodiment, both the variable heavy and variable light chain comprise a long (greater than 6 amino acids) linker. In another embodiment, the variable heavy chain comprises a short linker and the variable light chain comprises a long linker. In another embodiment, the variable heavy chain comprises a long linker and the variable light chain comprises a short linker.

In an embodiment the binding protein disclosed herein comprises a polypeptide chain, wherein said polypeptide chain comprises VD1-(X1)n-VD2-C—(X2)n, wherein VD1 is a first light chain variable domain, VD2 is a second light chain variable domain, C is a light chain constant domain, X1 is a linker with the proviso that it is not CH1, and X2 does not comprise an Fc region.

In another embodiment, a binding protein comprising two polypeptide chains, wherein said first polypeptide chain comprises VD1-(X1)n-VD2-C—(X2)n, wherein VD1 is a first heavy chain variable domain, VD2 is a second heavy chain variable domain, C is a heavy chain constant domain, X1 is a linker with the proviso that it is not CH1, and X2 is an Fc region; and said second polypeptide chain comprises VD1-(X1)n-VD2-C—(X2)n, wherein VD1 is a first light chain variable domain, VD2 is a second light chain variable domain, C is a light chain constant domain, X1 is a linker with the proviso that it is not CH1, and X2 does not comprise an Fc region is provided. In a particular embodiment, the Dual Variable Domain (DVD) binding protein comprises four polypeptide chains wherein the first two polypeptide chains comprises VD1-(X1)n-VD2-C—(X2)n, respectively wherein VD1 is a first heavy chain variable domain, VD2 is a second heavy chain variable domain, C is a heavy chain constant domain, X1 is a linker with the proviso that it is not CH1, and X2 is an Fc region; and the second two polypeptide chain comprises VD1-(X1)n-VD2-C—(X2)n respectively, wherein VD1 is a first light chain variable domain, VD2 is a second light chain variable domain, C is a light chain constant domain, X1 is a linker with the proviso that it is not CH1, and X2 does not comprise an Fc region. Such a Dual Variable Domain (DVD) protein has four antigen binding sites.

In another embodiment the binding proteins disclosed herein are capable of binding one or more targets. Accordingly, in some embodiments, the binding proteins comprise at least two variable domain sequences (e.g., VD1 and VD2) capable of binding at least two different targets. In some embodiments, VD1 and VD2 are independently chosen. Therefore, in some embodiments, VD1 and VD2 comprise the same SEQ ID NO and, in other embodiments, VD1 and VD2 comprise different SEQ ID NOS.

In another embodiment the binding proteins disclosed herein bind one or more targets. In an embodiment, the target is a cytokine, a cell surface protein, an enzyme, or a receptor. In another embodiment, the binding protein modulates a biological function of one or more targets. In another embodiment, the binding protein neutralizes one or more targets. In yet another embodiment, the cytokine is a lymphokine, monokine, polypeptide hormone, receptor, or tumor marker. For example, in some embodiments, the binding protein is capable of binding two or more of the following: IL-1β (seq. 1), IL-1β (seq. 2), IL-1β (seq. 3), IL-1β (seq. 4), IL-1β (seq. 5), IL-17 (seq. 1), IL-17 (seq. 2), or IL-17 (seq. 3).

In another embodiment, the binding protein capable of binding IL-1β (seq. 1) and IL-17 (seq. 1) comprises a DVD heavy chain amino acid sequence SEQ ID NO. 50 or SEQ ID NO. 52; and a DVD light chain amino acid sequence SEQ ID NO. 51 or SEQ ID NO. 53. In an embodiment, the binding protein capable of binding IL-1β (seq. 1) and IL-17 (seq. 1) comprises a DVD heavy chain amino acid sequence of SEQ ID NO.50 and a DVD light chain amino acid sequence of SEQ ID NO: 51. In another embodiment, the binding protein capable of binding IL-1β (seq. 1) and IL-17 (seq. 1) has a reverse orientation and comprises a DVD heavy chain amino acid sequence of SEQ ID NO. 52 and a DVD light chain amino acid sequence of SEQ ID NO: 53.

In another embodiment, the binding protein capable of binding IL-1β (seq. 2) and IL-17 (seq. 1) comprises a DVD heavy chain amino acid sequence SEQ ID NO. 54 or SEQ ID NO. 56; and a DVD light chain amino acid sequence SEQ ID NO. 55 or SEQ ID NO. 57. In an embodiment, the binding protein capable of binding IL-1β (seq. 2) and IL-17 (seq. 1) comprises a DVD heavy chain amino acid sequence of SEQ ID NO. 54 and a DVD light chain amino acid sequence of SEQ ID NO: 55. In another embodiment, the binding protein capable of binding IL-1β (seq. 2) and IL-17 (seq. 1) has a reverse orientation and comprises a DVD heavy chain amino acid sequence of SEQ ID NO. 56 and a DVD light chain amino acid sequence of SEQ ID NO: 57.

In another embodiment, the binding protein capable of binding IL-1β (seq. 3) and IL-17 (seq. 1) comprises a DVD heavy chain amino acid sequence SEQ ID NO. 58 or SEQ ID NO. 60; and a DVD light chain amino acid sequence SEQ ID NO. 59 or SEQ ID NO. 61. In an embodiment, the binding protein capable of binding IL-1β (seq. 3) and IL-17 (seq. 1) comprises a DVD heavy chain amino acid sequence of SEQ ID NO. 58 and a DVD light chain amino acid sequence of SEQ ID NO: 59. In another embodiment, the binding protein capable of binding IL-1β (seq. 3) and IL-17 (seq. 1) has a reverse orientation and comprises a DVD heavy chain amino acid sequence of SEQ ID NO. 60 and a DVD light chain amino acid sequence of SEQ ID NO: 61.

In another embodiment, the binding protein capable of binding IL-1β (seq. 4) and IL-17 (seq. 1) comprises a DVD heavy chain amino acid sequence SEQ ID NO. 62 or SEQ ID NO. 64; and a DVD light chain amino acid sequence SEQ ID NO. 63 or SEQ ID NO. 65. In an embodiment, the binding protein capable of binding IL-1β (seq. 4) and IL-17 (seq. 1) comprises a DVD heavy chain amino acid sequence of SEQ ID NO. 62 and a DVD light chain amino acid sequence of SEQ ID NO: 63. In another embodiment, the binding protein capable of binding IL-1β (seq. 4) and IL-17 (seq. 1) has a reverse orientation and comprises a DVD heavy chain amino acid sequence of SEQ ID NO. 64 and a DVD light chain amino acid sequence of SEQ ID NO: 65.

In another embodiment, the binding protein capable of binding IL-1β (seq. 5) and IL-17 (seq. 1) comprises a DVD heavy chain amino acid sequence SEQ ID NO. 66 or SEQ ID NO. 68; and a DVD light chain amino acid sequence SEQ ID NO. 67 or SEQ ID NO. 69. In an embodiment, the binding protein capable of binding IL-1β (seq. 5) and IL-17 (seq. 1) comprises a DVD heavy chain amino acid sequence of SEQ ID NO. 66 and a DVD light chain amino acid sequence of SEQ ID NO: 67. In another embodiment, the binding protein capable of binding IL-1β (seq. 5) and IL-17 (seq. 1) has a reverse orientation and comprises a DVD heavy chain amino acid sequence of SEQ ID NO. 68 and a DVD light chain amino acid sequence of SEQ ID NO: 69.

In another embodiment, the binding protein capable of binding IL-1β (seq. 1) and IL-17 (seq. 2) comprises a DVD heavy chain amino acid sequence SEQ ID NO. 70 or SEQ ID NO. 72; and a DVD light chain amino acid sequence SEQ ID NO. 71 or SEQ ID NO. 73. In an embodiment, the binding protein capable of binding IL-1β (seq. 1) and IL-17 (seq. 2) comprises a DVD heavy chain amino acid sequence of SEQ ID NO. 70 and a DVD light chain amino acid sequence of SEQ ID NO: 71. In another embodiment, the binding protein capable of binding IL-1β (seq. 1) and IL-17 (seq. 2) has a reverse orientation and comprises a DVD heavy chain amino acid sequence of SEQ ID NO. 72 and a DVD light chain amino acid sequence of SEQ ID NO: 73.

In another embodiment, the binding protein capable of binding IL-1β (seq. 2) and IL-17 (seq. 2) comprises a DVD heavy chain amino acid sequence SEQ ID NO. 74 or SEQ ID NO. 76; and a DVD light chain amino acid sequence SEQ ID NO. 75 or SEQ ID NO. 77. In an embodiment, the binding protein capable of binding IL-1β (seq. 2) and IL-17 (seq. 2) comprises a DVD heavy chain amino acid sequence of SEQ ID NO. 74 and a DVD light chain amino acid sequence of SEQ ID NO: 75. In another embodiment, the binding protein capable of binding IL-1β (seq. 2) and IL-17 (seq. 2) has a reverse orientation and comprises a DVD heavy chain amino acid sequence of SEQ ID NO. 76 and a DVD light chain amino acid sequence of SEQ ID NO: 77.

In another embodiment, the binding protein capable of binding IL-1β (seq. 2) and IL-17 (seq. 3) comprises a DVD heavy chain amino acid sequence SEQ ID NO. 78 or SEQ ID NO. 80; and a DVD light chain amino acid sequence SEQ ID NO. 79 or SEQ ID NO. 81. In an embodiment, the binding protein capable of binding IL-1β (seq. 3) and IL-17 (seq. 2) comprises a DVD heavy chain amino acid sequence of SEQ ID NO. 78 and a DVD light chain amino acid sequence of SEQ ID NO: 79. In another embodiment, the binding protein capable of binding IL-1β (seq. 3) and IL-17 (seq. 2) has a reverse orientation and comprises a DVD heavy chain amino acid sequence of SEQ ID NO. 80 and a DVD light chain amino acid sequence of SEQ ID NO: 81.

In another embodiment, the binding protein capable of binding IL-1β (seq. 2) and IL-17 (seq. 4) comprises a DVD heavy chain amino acid sequence SEQ ID NO. 82 or SEQ ID NO. 84; and a DVD light chain amino acid sequence SEQ ID NO. 83 or SEQ ID NO. 85. In an embodiment, the binding protein capable of binding IL-1β (seq. 4) and IL-17 (seq. 2) comprises a DVD heavy chain amino acid sequence of SEQ ID NO. 82 and a DVD light chain amino acid sequence of SEQ ID NO: 83. In another embodiment, the binding protein capable of binding IL-1β (seq. 4) and IL-17 (seq. 2) has a reverse orientation and comprises a DVD heavy chain amino acid sequence of SEQ ID NO. 84 and a DVD light chain amino acid sequence of SEQ ID NO: 85.

In another embodiment, the binding protein capable of binding IL-1β (seq. 5) and IL-17 (seq. 2) comprises a DVD heavy chain amino acid sequence SEQ ID NO. 86 or SEQ ID NO. 88; and a DVD light chain amino acid sequence SEQ ID NO. 87 or SEQ ID NO. 89. In an embodiment, the binding protein capable of binding IL-1β (seq. 5) and IL-17 (seq. 2) comprises a DVD heavy chain amino acid sequence of SEQ ID NO. 86 and a DVD light chain amino acid sequence of SEQ ID NO: 87. In another embodiment, the binding protein capable of binding IL-1β (seq. 5) and IL-17 (seq. 2) has a reverse orientation and comprises a DVD heavy chain amino acid sequence of SEQ ID NO. 88 and a DVD light chain amino acid sequence of SEQ ID NO: 89.

In another embodiment, the binding protein capable of binding IL-1β (seq. 1) and IL-17 (seq. 3) comprises a DVD heavy chain amino acid sequence SEQ ID NO. 90 or SEQ ID NO. 92; and a DVD light chain amino acid sequence SEQ ID NO. 91 or SEQ ID NO. 93. In an embodiment, the binding protein capable of binding IL-1β (seq. 1) and IL-17 (seq. 3) comprises a DVD heavy chain amino acid sequence of SEQ ID NO. 90 and a DVD light chain amino acid sequence of SEQ ID NO: 91. In another embodiment, the binding protein capable of binding IL-1β (seq. 1) and IL-17 (seq. 3) has a reverse orientation and comprises a DVD heavy chain amino acid sequence of SEQ ID NO. 92 and a DVD light chain amino acid sequence of SEQ ID NO: 93.

In another embodiment, the binding protein capable of binding IL-1β (seq. 2) and IL-17 (seq. 3) comprises a DVD heavy chain amino acid sequence SEQ ID NO. 94 or SEQ ID NO. 96; and a DVD light chain amino acid sequence SEQ ID NO. 95 or SEQ ID NO. 97. In an embodiment, the binding protein capable of binding IL-1β (seq. 2) and IL-17 (seq. 3) comprises a DVD heavy chain amino acid sequence of SEQ ID NO. 94 and a DVD light chain amino acid sequence of SEQ ID NO: 95. In another embodiment, the binding protein capable of binding IL-1β (seq. 2) and IL-17 (seq. 3) has a reverse orientation and comprises a DVD heavy chain amino acid sequence of SEQ ID NO. 96 and a DVD light chain amino acid sequence of SEQ ID NO: 97.

In another embodiment, the binding protein capable of binding IL-1β (seq. 3) and IL-17 (seq. 3) comprises a DVD heavy chain amino acid sequence SEQ ID NO. 98 or SEQ ID NO. 100; and a DVD light chain amino acid sequence SEQ ID NO. 99 or SEQ ID NO. 101. In an embodiment, the binding protein capable of binding IL-1β (seq. 3) and IL-17 (seq. 3) comprises a DVD heavy chain amino acid sequence of SEQ ID NO. 98 and a DVD light chain amino acid sequence of SEQ ID NO: 99. In another embodiment, the binding protein capable of binding IL-1β (seq. 3) and IL-17 (seq. 3) has a reverse orientation and comprises a DVD heavy chain amino acid sequence of SEQ ID NO. 100 and a DVD light chain amino acid sequence of SEQ ID NO: 101.

In another embodiment, the binding protein capable of binding IL-1β (seq. 4) and IL-17 (seq. 3) comprises a DVD heavy chain amino acid sequence SEQ ID NO. 102 or SEQ ID NO. 104; and a DVD light chain amino acid sequence SEQ ID NO. 103 or SEQ ID NO. 105. In an embodiment, the binding protein capable of binding IL-1β (seq. 4) and IL-17 (seq. 3) comprises a DVD heavy chain amino acid sequence of SEQ ID NO. 102 and a DVD light chain amino acid sequence of SEQ ID NO: 103. In another embodiment, the binding protein capable of binding IL-1β (seq. 4) and IL-17 (seq. 3) has a reverse orientation and comprises a DVD heavy chain amino acid sequence of SEQ ID NO. 104 and a DVD light chain amino acid sequence of SEQ ID NO: 105.

In another embodiment, the binding protein capable of binding IL-1β (seq. 5) and IL-17 (seq. 3) comprises a DVD heavy chain amino acid sequence SEQ ID NO. 106 or SEQ ID NO. 108; and a DVD light chain amino acid sequence SEQ ID NO. 107 or SEQ ID NO. 109. In an embodiment, the binding protein capable of binding IL-1β (seq. 5) and IL-17 (seq. 3) comprises a DVD heavy chain amino acid sequence of SEQ ID NO. 106 and a DVD light chain amino acid sequence of SEQ ID NO: 107. In another embodiment, the binding protein capable of binding IL-1β (seq. 5) and IL-17 (seq. 3) has a reverse orientation and comprises a DVD heavy chain amino acid sequence of SEQ ID NO. 108 and a DVD light chain amino acid sequence of SEQ ID NO: 109.

In another embodiment, the binding protein capable of binding IL-1β (seq. 1) and IL-17 (seq. 1) comprises a DVD heavy chain amino acid sequence SEQ ID NO. 110 or SEQ ID NO. 112; and a DVD light chain amino acid sequence SEQ ID NO. 111 or SEQ ID NO. 113. In an embodiment, the binding protein capable of binding IL-1β (seq. 1) and IL-17 (seq. 1) comprises a DVD heavy chain amino acid sequence of SEQ ID NO.110 and a DVD light chain amino acid sequence of SEQ ID NO: 111. In another embodiment, the binding protein capable of binding IL-1β (seq. 1) and IL-17 (seq. 1) has a reverse orientation and comprises a DVD heavy chain amino acid sequence of SEQ ID NO. 112 and a DVD light chain amino acid sequence of SEQ ID NO: 113.

In another embodiment, the binding protein capable of binding IL-1β (seq. 2) and IL-17 (seq. 1) comprises a DVD heavy chain amino acid sequence SEQ ID NO. 114 or SEQ ID NO. 116; and a DVD light chain amino acid sequence SEQ ID NO. 115 or SEQ ID NO. 117. In an embodiment, the binding protein capable of binding IL-1β (seq. 2) and IL-17 (seq. 1) comprises a DVD heavy chain amino acid sequence of SEQ ID NO. 114 and a DVD light chain amino acid sequence of SEQ ID NO: 115. In another embodiment, the binding protein capable of binding IL-1β (seq. 2) and IL-17 (seq. 1) has a reverse orientation and comprises a DVD heavy chain amino acid sequence of SEQ ID NO. 116 and a DVD light chain amino acid sequence of SEQ ID NO: 117.

In another embodiment, the binding protein capable of binding IL-1β (seq. 3) and IL-17 (seq. 1) comprises a DVD heavy chain amino acid sequence SEQ ID NO. 118 or SEQ ID NO. 120; and a DVD light chain amino acid sequence SEQ ID NO. 119 or SEQ ID NO. 121. In an embodiment, the binding protein capable of binding IL-1β (seq. 3) and IL-17 (seq. 1) comprises a DVD heavy chain amino acid sequence of SEQ ID NO. 118 and a DVD light chain amino acid sequence of SEQ ID NO: 119. In another embodiment, the binding protein capable of binding IL-1β (seq. 3) and IL-17 (seq. 1) has a reverse orientation and comprises a DVD heavy chain amino acid sequence of SEQ ID NO. 120 and a DVD light chain amino acid sequence of SEQ ID NO: 121.

In another embodiment, the binding protein capable of binding IL-1β (seq. 4) and IL-17 (seq. 1) comprises a DVD heavy chain amino acid sequence SEQ ID NO. 122 or SEQ ID NO. 124; and a DVD light chain amino acid sequence SEQ ID NO. 123 or SEQ ID NO. 125. In an embodiment, the binding protein capable of binding IL-1β (seq. 4) and IL-17 (seq. 1) comprises a DVD heavy chain amino acid sequence of SEQ ID NO. 122 and a DVD light chain amino acid sequence of SEQ ID NO: 123. In another embodiment, the binding protein capable of binding IL-1β (seq. 4) and IL-17 (seq. 1) has a reverse orientation and comprises a DVD heavy chain amino acid sequence of SEQ ID NO. 124 and a DVD light chain amino acid sequence of SEQ ID NO: 125.

In another embodiment, the binding protein capable of binding IL-1β (seq. 5) and IL-17 (seq. 1) comprises a DVD heavy chain amino acid sequence SEQ ID NO. 126 or SEQ ID NO. 128; and a DVD light chain amino acid sequence SEQ ID NO. 127 or SEQ ID NO. 129. In an embodiment, the binding protein capable of binding IL-1β (seq. 5) and IL-17 (seq. 1) comprises a DVD heavy chain amino acid sequence of SEQ ID NO. 126 and a DVD light chain amino acid sequence of SEQ ID NO: 127. In another embodiment, the binding protein capable of binding IL-1β (seq. 5) and IL-17 (seq. 1) has a reverse orientation and comprises a DVD heavy chain amino acid sequence of SEQ ID NO. 128 and a DVD light chain amino acid sequence of SEQ ID NO: 129.

In another embodiment, the binding protein capable of binding IL-1β (seq. 1) and IL-17 (seq. 2) comprises a DVD heavy chain amino acid sequence SEQ ID NO. 130 or SEQ ID NO. 132; and a DVD light chain amino acid sequence SEQ ID NO. 131 or SEQ ID NO. 133. In an embodiment, the binding protein capable of binding IL-1β (seq. 1) and IL-17 (seq. 2) comprises a DVD heavy chain amino acid sequence of SEQ ID NO. 130 and a DVD light chain amino acid sequence of SEQ ID NO: 131. In another embodiment, the binding protein capable of binding IL-1β (seq. 1) and IL-17 (seq. 2) has a reverse orientation and comprises a DVD heavy chain amino acid sequence of SEQ ID NO. 132 and a DVD light chain amino acid sequence of SEQ ID NO: 133.

In another embodiment, the binding protein capable of binding IL-1β (seq. 2) and IL-17 (seq. 2) comprises a DVD heavy chain amino acid sequence SEQ ID NO. 134 or SEQ ID NO. 136; and a DVD light chain amino acid sequence SEQ ID NO. 135 or SEQ ID NO. 137. In an embodiment, the binding protein capable of binding IL-1β (seq. 2) and IL-17 (seq. 2) comprises a DVD heavy chain amino acid sequence of SEQ ID NO. 134 and a DVD light chain amino acid sequence of SEQ ID NO: 135. In another embodiment, the binding protein capable of binding IL-1β (seq. 2) and IL-17 (seq. 2) has a reverse orientation and comprises a DVD heavy chain amino acid sequence of SEQ ID NO. 136 and a DVD light chain amino acid sequence of SEQ ID NO: 137.

In another embodiment, the binding protein capable of binding IL-1β (seq. 2) and IL-17 (seq. 3) comprises a DVD heavy chain amino acid sequence SEQ ID NO. 138 or SEQ ID NO. 140; and a DVD light chain amino acid sequence SEQ ID NO. 139 or SEQ ID NO. 141. In an embodiment, the binding protein capable of binding IL-1β (seq. 3) and IL-17 (seq. 2) comprises a DVD heavy chain amino acid sequence of SEQ ID NO. 138 and a DVD light chain amino acid sequence of SEQ ID NO: 139. In another embodiment, the binding protein capable of binding IL-1β (seq. 3) and IL-17 (seq. 2) has a reverse orientation and comprises a DVD heavy chain amino acid sequence of SEQ ID NO. 140 and a DVD light chain amino acid sequence of SEQ ID NO: 141.

In another embodiment, the binding protein capable of binding IL-1β (seq. 2) and IL-17 (seq. 4) comprises a DVD heavy chain amino acid sequence SEQ ID NO. 142 or SEQ ID NO. 144; and a DVD light chain amino acid sequence SEQ ID NO. 143 or SEQ ID NO. 145. In an embodiment, the binding protein capable of binding IL-1β (seq. 4) and IL-17 (seq. 2) comprises a DVD heavy chain amino acid sequence of SEQ ID NO. 142 and a DVD light chain amino acid sequence of SEQ ID NO: 143. In another embodiment, the binding protein capable of binding IL-1β (seq. 4) and IL-17 (seq. 2) has a reverse orientation and comprises a DVD heavy chain amino acid sequence of SEQ ID NO. 144 and a DVD light chain amino acid sequence of SEQ ID NO: 145.

In another embodiment, the binding protein capable of binding IL-1β (seq. 5) and IL-17 (seq. 2) comprises a DVD heavy chain amino acid sequence SEQ ID NO. 146 or SEQ ID NO. 148; and a DVD light chain amino acid sequence SEQ ID NO. 147 or SEQ ID NO. 149. In an embodiment, the binding protein capable of binding IL-1β (seq. 5) and IL-17 (seq. 2) comprises a DVD heavy chain amino acid sequence of SEQ ID NO. 146 and a DVD light chain amino acid sequence of SEQ ID NO: 147. In another embodiment, the binding protein capable of binding IL-1β (seq. 5) and IL-17 (seq. 2) has a reverse orientation and comprises a DVD heavy chain amino acid sequence of SEQ ID NO. 148 and a DVD light chain amino acid sequence of SEQ ID NO: 149.

In another embodiment, the binding protein capable of binding IL-1β (seq. 1) and IL-17 (seq. 3) comprises a DVD heavy chain amino acid sequence SEQ ID NO. 150 or SEQ ID NO. 152; and a DVD light chain amino acid sequence SEQ ID NO. 151 or SEQ ID NO. 153. In an embodiment, the binding protein capable of binding IL-1β (seq. 1) and IL-17 (seq. 3) comprises a DVD heavy chain amino acid sequence of SEQ ID NO. 150 and a DVD light chain amino acid sequence of SEQ ID NO: 151. In another embodiment, the binding protein capable of binding IL-1β (seq. 1) and IL-17 (seq. 3) has a reverse orientation and comprises a DVD heavy chain amino acid sequence of SEQ ID NO. 152 and a DVD light chain amino acid sequence of SEQ ID NO: 153.

In another embodiment, the binding protein capable of binding IL-1β (seq. 2) and IL-17 (seq. 3) comprises a DVD heavy chain amino acid sequence SEQ ID NO. 154 or SEQ ID NO. 156; and a DVD light chain amino acid sequence SEQ ID NO. 155 or SEQ ID NO. 157. In an embodiment, the binding protein capable of binding IL-1β (seq. 2) and IL-17 (seq. 3) comprises a DVD heavy chain amino acid sequence of SEQ ID NO. 154 and a DVD light chain amino acid sequence of SEQ ID NO: 155. In another embodiment, the binding protein capable of binding IL-1β (seq. 2) and IL-17 (seq. 3) has a reverse orientation and comprises a DVD heavy chain amino acid sequence of SEQ ID NO. 156 and a DVD light chain amino acid sequence of SEQ ID NO: 157.

In another embodiment, the binding protein capable of binding IL-1β (seq. 3) and IL-17 (seq. 3) comprises a DVD heavy chain amino acid sequence SEQ ID NO. 158 or SEQ ID NO. 160; and a DVD light chain amino acid sequence SEQ ID NO. 159 or SEQ ID NO. 161. In an embodiment, the binding protein capable of binding IL-1β (seq. 3) and IL-17 (seq. 3) comprises a DVD heavy chain amino acid sequence of SEQ ID NO. 158 and a DVD light chain amino acid sequence of SEQ ID NO: 159. In another embodiment, the binding protein capable of binding IL-1β (seq. 3) and IL-17 (seq. 3) has a reverse orientation and comprises a DVD heavy chain amino acid sequence of SEQ ID NO. 160 and a DVD light chain amino acid sequence of SEQ ID NO: 161.

In another embodiment, the binding protein capable of binding IL-1β (seq. 4) and IL-17 (seq. 3) comprises a DVD heavy chain amino acid sequence SEQ ID NO. 162 or SEQ ID NO. 164; and a DVD light chain amino acid sequence SEQ ID NO. 163 or SEQ ID NO. 165. In an embodiment, the binding protein capable of binding IL-1β (seq. 4) and IL-17 (seq. 3) comprises a DVD heavy chain amino acid sequence of SEQ ID NO. 162 and a DVD light chain amino acid sequence of SEQ ID NO: 163. In another embodiment, the binding protein capable of binding IL-1β (seq. 4) and IL-17 (seq. 3) has a reverse orientation and comprises a DVD heavy chain amino acid sequence of SEQ ID NO. 164 and a DVD light chain amino acid sequence of SEQ ID NO: 165.

In another embodiment, the binding protein capable of binding IL-1β (seq. 5) and IL-17 (seq. 3) comprises a DVD heavy chain amino acid sequence SEQ ID NO. 166 or SEQ ID NO. 168; and a DVD light chain amino acid sequence SEQ ID NO. 167 or SEQ ID NO. 169. In an embodiment, the binding protein capable of binding IL-1β (seq. 5) and IL-17 (seq. 3) comprises a DVD heavy chain amino acid sequence of SEQ ID NO. 166 and a DVD light chain amino acid sequence of SEQ ID NO: 167. In another embodiment, the binding protein capable of binding IL-1β (seq. 5) and IL-17 (seq. 3) has a reverse orientation and comprises a DVD heavy chain amino acid sequence of SEQ ID NO. 168 and a DVD light chain amino acid sequence of SEQ ID NO: 169.

In another embodiment, the binding protein capable of binding IL-1β (seq. 1) and IL-17 (seq. 1) comprises a DVD heavy chain amino acid sequence SEQ ID NO. 170 or SEQ ID NO. 172; and a DVD light chain amino acid sequence SEQ ID NO. 171 or SEQ ID NO. 173. In an embodiment, the binding protein capable of binding IL-1β (seq. 1) and IL-17 (seq. 1) comprises a DVD heavy chain amino acid sequence of SEQ ID NO:170 and a DVD light chain amino acid sequence of SEQ ID NO: 171. In another embodiment, the binding protein capable of binding IL-1β (seq. 1) and IL-17 (seq. 1) has a reverse orientation and comprises a DVD heavy chain amino acid sequence of SEQ ID NO. 172 and a DVD light chain amino acid sequence of SEQ ID NO: 173.

In another embodiment, the binding protein capable of binding IL-1β (seq. 2) and IL-17 (seq. 1) comprises a DVD heavy chain amino acid sequence SEQ ID NO. 174 or SEQ ID NO. 176; and a DVD light chain amino acid sequence SEQ ID NO. 175 or SEQ ID NO. 177. In an embodiment, the binding protein capable of binding IL-1β (seq. 2) and IL-17 (seq. 1) comprises a DVD heavy chain amino acid sequence of SEQ ID NO. 174 and a DVD light chain amino acid sequence of SEQ ID NO: 175. In another embodiment, the binding protein capable of binding IL-1β (seq. 2) and IL-17 (seq. 1) has a reverse orientation and comprises a DVD heavy chain amino acid sequence of SEQ ID NO. 176 and a DVD light chain amino acid sequence of SEQ ID NO: 177.

In another embodiment, the binding protein capable of binding IL-1β (seq. 3) and IL-17 (seq. 1) comprises a DVD heavy chain amino acid sequence SEQ ID NO. 178 or SEQ ID NO. 180; and a DVD light chain amino acid sequence SEQ ID NO. 179 or SEQ ID NO. 181. In an embodiment, the binding protein capable of binding IL-1β (seq. 3) and IL-17 (seq. 1) comprises a DVD heavy chain amino acid sequence of SEQ ID NO. 178 and a DVD light chain amino acid sequence of SEQ ID NO: 179. In another embodiment, the binding protein capable of binding IL-1β (seq. 3) and IL-17 (seq. 1) has a reverse orientation and comprises a DVD heavy chain amino acid sequence of SEQ ID NO. 180 and a DVD light chain amino acid sequence of SEQ ID NO: 181.

In another embodiment, the binding protein capable of binding IL-1β (seq. 4) and IL-17 (seq. 1) comprises a DVD heavy chain amino acid sequence SEQ ID NO. 182 or SEQ ID NO. 184; and a DVD light chain amino acid sequence SEQ ID NO. 183 or SEQ ID NO. 185. In an embodiment, the binding protein capable of binding IL-1β (seq. 4) and IL-17 (seq. 1) comprises a DVD heavy chain amino acid sequence of SEQ ID NO. 182 and a DVD light chain amino acid sequence of SEQ ID NO: 183. In another embodiment, the binding protein capable of binding IL-1β (seq. 4) and IL-17 (seq. 1) has a reverse orientation and comprises a DVD heavy chain amino acid sequence of SEQ ID NO. 184 and a DVD light chain amino acid sequence of SEQ ID NO: 185.

In another embodiment, the binding protein capable of binding IL-1β (seq. 5) and IL-17 (seq. 1) comprises a DVD heavy chain amino acid sequence SEQ ID NO. 186 or SEQ ID NO. 188; and a DVD light chain amino acid sequence SEQ ID NO. 187 or SEQ ID NO. 189. In an embodiment, the binding protein capable of binding IL-1β (seq. 5) and IL-17 (seq. 1) comprises a DVD heavy chain amino acid sequence of SEQ ID NO. 186 and a DVD light chain amino acid sequence of SEQ ID NO: 187. In another embodiment, the binding protein capable of binding IL-1β (seq. 5) and IL-17 (seq. 1) has a reverse orientation and comprises a DVD heavy chain amino acid sequence of SEQ ID NO. 188 and a DVD light chain amino acid sequence of SEQ ID NO: 189.

In another embodiment, the binding protein capable of binding IL-1β (seq. 1) and IL-17 (seq. 2) comprises a DVD heavy chain amino acid sequence SEQ ID NO. 190 or SEQ ID NO. 192; and a DVD light chain amino acid sequence SEQ ID NO. 191 or SEQ ID NO. 193. In an embodiment, the binding protein capable of binding IL-1β (seq. 1) and IL-17 (seq. 2) comprises a DVD heavy chain amino acid sequence of SEQ ID NO. 190 and a DVD light chain amino acid sequence of SEQ ID NO: 191. In another embodiment, the binding protein capable of binding IL-1β (seq. 1) and IL-17 (seq. 2) has a reverse orientation and comprises a DVD heavy chain amino acid sequence of SEQ ID NO. 192 and a DVD light chain amino acid sequence of SEQ ID NO: 193.

In another embodiment, the binding protein capable of binding IL-1β (seq. 2) and IL-17 (seq. 2) comprises a DVD heavy chain amino acid sequence SEQ ID NO. 194 or SEQ ID NO. 196; and a DVD light chain amino acid sequence SEQ ID NO. 195 or SEQ ID NO. 197. In an embodiment, the binding protein capable of binding IL-1β (seq. 2) and IL-17 (seq. 2) comprises a DVD heavy chain amino acid sequence of SEQ ID NO. 194 and a DVD light chain amino acid sequence of SEQ ID NO: 195. In another embodiment, the binding protein capable of binding IL-1β (seq. 2) and IL-17 (seq. 2) has a reverse orientation and comprises a DVD heavy chain amino acid sequence of SEQ ID NO. 196 and a DVD light chain amino acid sequence of SEQ ID NO: 197.

In another embodiment, the binding protein capable of binding IL-1β (seq. 2) and IL-17 (seq. 3) comprises a DVD heavy chain amino acid sequence SEQ ID NO. 198 or SEQ ID NO. 200; and a DVD light chain amino acid sequence SEQ ID NO. 199 or SEQ ID NO. 201. In an embodiment, the binding protein capable of binding IL-1β (seq. 3) and IL-17 (seq. 2) comprises a DVD heavy chain amino acid sequence of SEQ ID NO. 198 and a DVD light chain amino acid sequence of SEQ ID NO: 199. In another embodiment, the binding protein capable of binding IL-1β (seq. 3) and IL-17 (seq. 2) has a reverse orientation and comprises a DVD heavy chain amino acid sequence of SEQ ID NO. 200 and a DVD light chain amino acid sequence of SEQ ID NO: 201.

In another embodiment, the binding protein capable of binding IL-1β (seq. 2) and IL-17 (seq. 4) comprises a DVD heavy chain amino acid sequence SEQ ID NO. 202 or SEQ ID NO. 204; and a DVD light chain amino acid sequence SEQ ID NO. 203 or SEQ ID NO. 205. In an embodiment, the binding protein capable of binding IL-1β (seq. 4) and IL-17 (seq. 2) comprises a DVD heavy chain amino acid sequence of SEQ ID NO. 202 and a DVD light chain amino acid sequence of SEQ ID NO: 203. In another embodiment, the binding protein capable of binding IL-1β (seq. 4) and IL-17 (seq. 2) has a reverse orientation and comprises a DVD heavy chain amino acid sequence of SEQ ID NO. 204 and a DVD light chain amino acid sequence of SEQ ID NO: 205.

In another embodiment, the binding protein capable of binding IL-1β (seq. 5) and IL-17 (seq. 2) comprises a DVD heavy chain amino acid sequence SEQ ID NO. 206 or SEQ ID NO. 208; and a DVD light chain amino acid sequence SEQ ID NO. 207 or SEQ ID NO. 209. In an embodiment, the binding protein capable of binding IL-1β (seq. 5) and IL-17 (seq. 2) comprises a DVD heavy chain amino acid sequence of SEQ ID NO. 206 and a DVD light chain amino acid sequence of SEQ ID NO: 207. In another embodiment, the binding protein capable of binding IL-1β (seq. 5) and IL-17 (seq. 2) has a reverse orientation and comprises a DVD heavy chain amino acid sequence of SEQ ID NO. 208 and a DVD light chain amino acid sequence of SEQ ID NO: 209.

In another embodiment, the binding protein capable of binding IL-1β (seq. 1) and IL-17 (seq. 3) comprises a DVD heavy chain amino acid sequence SEQ ID NO. 210 or SEQ ID NO. 212; and a DVD light chain amino acid sequence SEQ ID NO. 211 or SEQ ID NO. 213. In an embodiment, the binding protein capable of binding IL-1β (seq. 1) and IL-17 (seq. 3) comprises a DVD heavy chain amino acid sequence of SEQ ID NO. 210 and a DVD light chain amino acid sequence of SEQ ID NO: 211. In another embodiment, the binding protein capable of binding IL-1β (seq. 1) and IL-17 (seq. 3) has a reverse orientation and comprises a DVD heavy chain amino acid sequence of SEQ ID NO. 212 and a DVD light chain amino acid sequence of SEQ ID NO: 213.

In another embodiment, the binding protein capable of binding IL-1β (seq. 2) and IL-17 (seq. 3) comprises a DVD heavy chain amino acid sequence SEQ ID NO. 214 or SEQ ID NO. 216; and a DVD light chain amino acid sequence SEQ ID NO. 215 or SEQ ID NO. 217. In an embodiment, the binding protein capable of binding IL-1β (seq. 2) and IL-17 (seq. 3) comprises a DVD heavy chain amino acid sequence of SEQ ID NO. 214 and a DVD light chain amino acid sequence of SEQ ID NO: 215. In another embodiment, the binding protein capable of binding IL-1β (seq. 2) and IL-17 (seq. 3) has a reverse orientation and comprises a DVD heavy chain amino acid sequence of SEQ ID NO. 216 and a DVD light chain amino acid sequence of SEQ ID NO: 217.

In another embodiment, the binding protein capable of binding IL-1β (seq. 3) and IL-17 (seq. 3) comprises a DVD heavy chain amino acid sequence SEQ ID NO. 218 or SEQ ID NO. 220; and a DVD light chain amino acid sequence SEQ ID NO. 219 or SEQ ID NO. 221. In an embodiment, the binding protein capable of binding IL-1β (seq. 3) and IL-17 (seq. 3) comprises a DVD heavy chain amino acid sequence of SEQ ID NO. 218 and a DVD light chain amino acid sequence of SEQ ID NO: 219. In another embodiment, the binding protein capable of binding IL-1β (seq. 3) and IL-17 (seq. 3) has a reverse orientation and comprises a DVD heavy chain amino acid sequence of SEQ ID NO. 220 and a DVD light chain amino acid sequence of SEQ ID NO: 221.

In another embodiment, the binding protein capable of binding IL-1β (seq. 4) and IL-17 (seq. 3) comprises a DVD heavy chain amino acid sequence SEQ ID NO. 222 or SEQ ID NO. 224; and a DVD light chain amino acid sequence SEQ ID NO. 223 or SEQ ID NO. 225. In an embodiment, the binding protein capable of binding IL-1β (seq. 4) and IL-17 (seq. 3) comprises a DVD heavy chain amino acid sequence of SEQ ID NO. 222 and a DVD light chain amino acid sequence of SEQ ID NO: 223. In another embodiment, the binding protein capable of binding IL-1β (seq. 4) and IL-17 (seq. 3) has a reverse orientation and comprises a DVD heavy chain amino acid sequence of SEQ ID NO. 224 and a DVD light chain amino acid sequence of SEQ ID NO: 225.

In another embodiment, the binding protein capable of binding IL-1β (seq. 5) and IL-17 (seq. 3) comprises a DVD heavy chain amino acid sequence SEQ ID NO. 226 or SEQ ID NO. 228; and a DVD light chain amino acid sequence SEQ ID NO. 227 or SEQ ID NO. 229. In an embodiment, the binding protein capable of binding IL-1β (seq. 5) and IL-17 (seq. 3) comprises a DVD heavy chain amino acid sequence of SEQ ID NO. 226 and a DVD light chain amino acid sequence of SEQ ID NO: 227. In another embodiment, the binding protein capable of binding IL-1β (seq. 5) and IL-17 (seq. 3) has a reverse orientation and comprises a DVD heavy chain amino acid sequence of SEQ ID NO. 228 and a DVD light chain amino acid sequence of SEQ ID NO: 229.

In another embodiment, the binding protein capable of binding IL-1β (seq. 1) and IL-17 (seq. 1) comprises a DVD heavy chain amino acid sequence SEQ ID NO. 230 or SEQ ID NO. 232; and a DVD light chain amino acid sequence SEQ ID NO. 231 or SEQ ID NO. 233. In an embodiment, the binding protein capable of binding IL-1β (seq. 1) and IL-17 (seq. 1) comprises a DVD heavy chain amino acid sequence of SEQ ID NO:230 and a DVD light chain amino acid sequence of SEQ ID NO: 231. In another embodiment, the binding protein capable of binding IL-1β (seq. 1) and IL-17 (seq. 1) has a reverse orientation and comprises a DVD heavy chain amino acid sequence of SEQ ID NO. 232 and a DVD light chain amino acid sequence of SEQ ID NO: 233.

In another embodiment, the binding protein capable of binding IL-1β (seq. 2) and IL-17 (seq. 1) comprises a DVD heavy chain amino acid sequence SEQ ID NO. 234 or SEQ ID NO. 236; and a DVD light chain amino acid sequence SEQ ID NO. 235 or SEQ ID NO. 237. In an embodiment, the binding protein capable of binding IL-1β (seq. 2) and IL-17 (seq. 1) comprises a DVD heavy chain amino acid sequence of SEQ ID NO. 234 and a DVD light chain amino acid sequence of SEQ ID NO: 235. In another embodiment, the binding protein capable of binding IL-1β (seq. 2) and IL-17 (seq. 1) has a reverse orientation and comprises a DVD heavy chain amino acid sequence of SEQ ID NO. 236 and a DVD light chain amino acid sequence of SEQ ID NO: 237.

In another embodiment, the binding protein capable of binding IL-1β (seq. 3) and IL-17 (seq. 1) comprises a DVD heavy chain amino acid sequence SEQ ID NO. 238 or SEQ ID NO. 240; and a DVD light chain amino acid sequence SEQ ID NO. 239 or SEQ ID NO. 241. In an embodiment, the binding protein capable of binding IL-1β (seq. 3) and IL-17 (seq. 1) comprises a DVD heavy chain amino acid sequence of SEQ ID NO. 238 and a DVD light chain amino acid sequence of SEQ ID NO: 239. In another embodiment, the binding protein capable of binding IL-1β (seq. 3) and IL-17 (seq. 1) has a reverse orientation and comprises a DVD heavy chain amino acid sequence of SEQ ID NO. 240 and a DVD light chain amino acid sequence of SEQ ID NO: 241.

In another embodiment, the binding protein capable of binding IL-1β (seq. 4) and IL-17 (seq. 1) comprises a DVD heavy chain amino acid sequence SEQ ID NO. 242 or SEQ ID NO. 244; and a DVD light chain amino acid sequence SEQ ID NO. 243 or SEQ ID NO. 245. In an embodiment, the binding protein capable of binding IL-1β (seq. 4) and IL-17 (seq. 1) comprises a DVD heavy chain amino acid sequence of SEQ ID NO. 242 and a DVD light chain amino acid sequence of SEQ ID NO: 243. In another embodiment, the binding protein capable of binding IL-1β (seq. 4) and IL-17 (seq. 1) has a reverse orientation and comprises a DVD heavy chain amino acid sequence of SEQ ID NO. 244 and a DVD light chain amino acid sequence of SEQ ID NO: 245.

In another embodiment, the binding protein capable of binding IL-1β (seq. 5) and IL-17 (seq. 1) comprises a DVD heavy chain amino acid sequence SEQ ID NO. 246 or SEQ ID NO. 248; and a DVD light chain amino acid sequence SEQ ID NO. 247 or SEQ ID NO. 249. In an embodiment, the binding protein capable of binding IL-1β (seq. 5) and IL-17 (seq. 1) comprises a DVD heavy chain amino acid sequence of SEQ ID NO. 246 and a DVD light chain amino acid sequence of SEQ ID NO: 247. In another embodiment, the binding protein capable of binding IL-1β (seq. 5) and IL-17 (seq. 1) has a reverse orientation and comprises a DVD heavy chain amino acid sequence of SEQ ID NO. 248 and a DVD light chain amino acid sequence of SEQ ID NO: 249.

In another embodiment, the binding protein capable of binding IL-1β (seq. 1) and IL-17 (seq. 2) comprises a DVD heavy chain amino acid sequence SEQ ID NO. 250 or SEQ ID NO. 252; and a DVD light chain amino acid sequence SEQ ID NO. 251 or SEQ ID NO. 253. In an embodiment, the binding protein capable of binding IL-1β (seq. 1) and IL-17 (seq. 2) comprises a DVD heavy chain amino acid sequence of SEQ ID NO. 250 and a DVD light chain amino acid sequence of SEQ ID NO: 251. In another embodiment, the binding protein capable of binding IL-1β (seq. 1) and IL-17 (seq. 2) has a reverse orientation and comprises a DVD heavy chain amino acid sequence of SEQ ID NO. 252 and a DVD light chain amino acid sequence of SEQ ID NO: 253.

In another embodiment, the binding protein capable of binding IL-1β (seq. 2) and IL-17 (seq. 2) comprises a DVD heavy chain amino acid sequence SEQ ID NO. 254 or SEQ ID NO. 256; and a DVD light chain amino acid sequence SEQ ID NO. 255 or SEQ ID NO. 257. In an embodiment, the binding protein capable of binding IL-1β (seq. 2) and IL-17 (seq. 2) comprises a DVD heavy chain amino acid sequence of SEQ ID NO. 254 and a DVD light chain amino acid sequence of SEQ ID NO: 255. In another embodiment, the binding protein capable of binding IL-1β (seq. 2) and IL-17 (seq. 2) has a reverse orientation and comprises a DVD heavy chain amino acid sequence of SEQ ID NO. 256 and a DVD light chain amino acid sequence of SEQ ID NO: 257.

In another embodiment, the binding protein capable of binding IL-1β (seq. 2) and IL-17 (seq. 3) comprises a DVD heavy chain amino acid sequence SEQ ID NO. 258 or SEQ ID NO. 260; and a DVD light chain amino acid sequence SEQ ID NO. 259 or SEQ ID NO. 261. In an embodiment, the binding protein capable of binding IL-1β (seq. 3) and IL-17 (seq. 2) comprises a DVD heavy chain amino acid sequence of SEQ ID NO. 258 and a DVD light chain amino acid sequence of SEQ ID NO: 259. In another embodiment, the binding protein capable of binding IL-1β (seq. 3) and IL-17 (seq. 2) has a reverse orientation and comprises a DVD heavy chain amino acid sequence of SEQ ID NO. 260 and a DVD light chain amino acid sequence of SEQ ID NO: 261.

In another embodiment, the binding protein capable of binding IL-1β (seq. 2) and IL-17 (seq. 4) comprises a DVD heavy chain amino acid sequence SEQ ID NO. 262 or SEQ ID NO. 264; and a DVD light chain amino acid sequence SEQ ID NO. 263 or SEQ ID NO. 265. In an embodiment, the binding protein capable of binding IL-1β (seq. 4) and IL-17 (seq. 2) comprises a DVD heavy chain amino acid sequence of SEQ ID NO. 262 and a DVD light chain amino acid sequence of SEQ ID NO: 263. In another embodiment, the binding protein capable of binding IL-1β (seq. 4) and IL-17 (seq. 2) has a reverse orientation and comprises a DVD heavy chain amino acid sequence of SEQ ID NO. 264 and a DVD light chain amino acid sequence of SEQ ID NO: 265.

In another embodiment, the binding protein capable of binding IL-1β (seq. 5) and IL-17 (seq. 2) comprises a DVD heavy chain amino acid sequence SEQ ID NO. 266 or SEQ ID NO. 268; and a DVD light chain amino acid sequence SEQ ID NO. 267 or SEQ ID NO. 269. In an embodiment, the binding protein capable of binding IL-1β (seq. 5) and IL-17 (seq. 2) comprises a DVD heavy chain amino acid sequence of SEQ ID NO. 266 and a DVD light chain amino acid sequence of SEQ ID NO: 267. In another embodiment, the binding protein capable of binding IL-1β (seq. 5) and IL-17 (seq. 2) has a reverse orientation and comprises a DVD heavy chain amino acid sequence of SEQ ID NO. 268 and a DVD light chain amino acid sequence of SEQ ID NO: 269.

In another embodiment, the binding protein capable of binding IL-1β (seq. 1) and IL-17 (seq. 3) comprises a DVD heavy chain amino acid sequence SEQ ID NO. 270 or SEQ ID NO. 272; and a DVD light chain amino acid sequence SEQ ID NO. 271 or SEQ ID NO. 273. In an embodiment, the binding protein capable of binding IL-1β (seq. 1) and IL-17 (seq. 3) comprises a DVD heavy chain amino acid sequence of SEQ ID NO. 270 and a DVD light chain amino acid sequence of SEQ ID NO: 271. In another embodiment, the binding protein capable of binding IL-1β (seq. 1) and IL-17 (seq. 3) has a reverse orientation and comprises a DVD heavy chain amino acid sequence of SEQ ID NO. 272 and a DVD light chain amino acid sequence of SEQ ID NO: 273.

In another embodiment, the binding protein capable of binding IL-1β (seq. 2) and IL-17 (seq. 3) comprises a DVD heavy chain amino acid sequence SEQ ID NO. 274 or SEQ ID NO. 276; and a DVD light chain amino acid sequence SEQ ID NO. 275 or SEQ ID NO. 277. In an embodiment, the binding protein capable of binding IL-1β (seq. 2) and IL-17 (seq. 3) comprises a DVD heavy chain amino acid sequence of SEQ ID NO. 274 and a DVD light chain amino acid sequence of SEQ ID NO: 275. In another embodiment, the binding protein capable of binding IL-1β (seq. 2) and IL-17 (seq. 3) has a reverse orientation and comprises a DVD heavy chain amino acid sequence of SEQ ID NO. 276 and a DVD light chain amino acid sequence of SEQ ID NO: 277.

In another embodiment, the binding protein capable of binding IL-1β (seq. 3) and IL-17 (seq. 3) comprises a DVD heavy chain amino acid sequence SEQ ID NO. 278 or SEQ ID NO. 280; and a DVD light chain amino acid sequence SEQ ID NO. 279 or SEQ ID NO. 281. In an embodiment, the binding protein capable of binding IL-1β (seq. 3) and IL-17 (seq. 3) comprises a DVD heavy chain amino acid sequence of SEQ ID NO. 278 and a DVD light chain amino acid sequence of SEQ ID NO: 279. In another embodiment, the binding protein capable of binding IL-1β (seq. 3) and IL-17 (seq. 3) has a reverse orientation and comprises a DVD heavy chain amino acid sequence of SEQ ID NO. 280 and a DVD light chain amino acid sequence of SEQ ID NO: 281.

In another embodiment, the binding protein capable of binding IL-1β (seq. 4) and IL-17 (seq. 3) comprises a DVD heavy chain amino acid sequence SEQ ID NO. 282 or SEQ ID NO. 284; and a DVD light chain amino acid sequence SEQ ID NO. 283 or SEQ ID NO. 285. In an embodiment, the binding protein capable of binding IL-1β (seq. 4) and IL-17 (seq. 3) comprises a DVD heavy chain amino acid sequence of SEQ ID NO. 282 and a DVD light chain amino acid sequence of SEQ ID NO: 283. In another embodiment, the binding protein capable of binding IL-1β (seq. 4) and IL-17 (seq. 3) has a reverse orientation and comprises a DVD heavy chain amino acid sequence of SEQ ID NO. 284 and a DVD light chain amino acid sequence of SEQ ID NO: 285.

In another embodiment, the binding protein capable of binding IL-1β (seq. 5) and IL-17 (seq. 3) comprises a DVD heavy chain amino acid sequence SEQ ID NO. 286 or SEQ ID NO. 288; and a DVD light chain amino acid sequence SEQ ID NO. 287 or SEQ ID NO. 289. In an embodiment, the binding protein capable of binding IL-1β (seq. 5) and IL-17 (seq. 3) comprises a DVD heavy chain amino acid sequence of SEQ ID NO. 286 and a DVD light chain amino acid sequence of SEQ ID NO: 287. In another embodiment, the binding protein capable of binding IL-1β (seq. 5) and IL-17 (seq. 3) has a reverse orientation and comprises a DVD heavy chain amino acid sequence of SEQ ID NO. 288 and a DVD light chain amino acid sequence of SEQ ID NO: 289.

In another embodiment, a binding protein comprising a polypeptide chain, wherein said polypeptide chain comprises VD1-(X1)n-VD2-C—(X2)n, wherein; VD1 is a first heavy chain variable domain obtained from a first parent antibody, or antigen binding portion thereof; VD2 is a second heavy chain variable domain obtained from a second parent antibody, or antigen binding portion thereof, which can be the same or different from the first parent antibody; C is a heavy chain constant domain; (X1)n is a linker with the proviso that it is not CH1, wherein said (X1)n is either present or absent; and (X2)n is an Fc region, wherein said (X2)n is either present or absent is provided. In an embodiment, the Fc region is absent from the binding protein.

In another embodiment, a binding protein comprising a polypeptide chain, wherein said polypeptide chain comprises VD1-(X1)n-VD2-C—(X2)n, wherein, VD1 is a first light chain variable domain obtained from a first parent antibody or antigen binding portion thereof; VD2 is a second light chain variable domain obtained from a second parent antibody or antigen binding portion thereof, which can be the same or different from the first parent antibody; C is a light chain constant domain; (X1)n is a linker with the proviso that it is not CH1, wherein said (X1)n is either present or absent; and (X2)n does not comprise an Fc region, wherein said (X2)n is either present or absent is provided. In an embodiment, (X2)n is absent from the binding protein.

In another embodiment, the binding protein comprises first and second polypeptide chains, wherein said first polypeptide chain comprises a first VD1-(X1)n-VD2-C—(X2)n, wherein VD1 is a first heavy chain variable domain obtained from a first parent antibody or antigen binding portion thereof; VD2 is a second heavy chain variable domain obtained from a second parent antibody or antigen binding portion thereof, which can be the same or different from the first parent antibody; C is a heavy chain constant domain; (X1)n is a linker with the proviso that it is not CH1, wherein said (X1)n is either present or absent; and (X2)n is an Fc region, wherein said (X2)n is either present or absent; and wherein said second polypeptide chain comprises a second VD1-(X1)n-VD2-C—(X2)n, wherein VD1 is a first light chain variable domain obtained from a first parent antibody or antigen binding portion thereof; VD2 is a second light chain variable domain obtained from a second parent antibody or antigen binding portion thereof, which can be the same or different from the first parent antibody; C is a light chain constant domain; (X1)n is a linker with the proviso that it is not CH1, wherein said (X1)n is either present or absent; and (X2)n does not comprise an Fc region, wherein said (X2)n is either present or absent. In another embodiment, the binding protein comprises two first polypeptide chains and two second polypeptide chains. In yet another embodiment, (X2)n is absent from the second polypeptide. In still another embodiment, the Fc region, if present in the first polypeptide is a native sequence Fc region or a variant sequence Fc region. In still another embodiment, the Fc region is an Fc region from an IgG1, an Fc region from an IgG2, an Fc region from an IgG3, an Fc region from an IgG4, an Fc region from an IgA, an Fc region from an IgM, an Fc region from an IgE, or an Fc region from an IgD.

In another embodiment, the binding protein is a DVD-Ig that binds two antigens comprising four polypeptide chains, wherein, each of the first and third polypeptide chains comprise VD1-(X1)n-VD2-C—(X2)n, wherein, VD1 is a first heavy chain variable domain obtained from a first parent antibody, or antigen binding portion thereof; VD2 is a second heavy chain variable domain obtained from a second parent antibody, or antigen binding portion thereof, which can be the same as or different from the first parent antibody; C is a heavy chain constant domain; (X1)n is a linker with the proviso that it is not CH1, wherein said (X1)n is either present or absent; and (X2)n is an Fc region, wherein said (X2)n is either present or absent; and wherein each of the second and fourth polypeptide chains comprise VD1-(X1)n-VD2-C—(X2)n, wherein VD1 is a first light chain variable domain obtained from a first parent antibody or antigen binding portion thereof; VD2 is a second light chain variable domain obtained from a second parent antibody, or antigen binding portion thereof, which can be the same as or different from the first parent antibody; C is a light chain constant domain; (X1)n is a linker with the proviso that it is not CH1, wherein said (X1)n is either present or absent; and (X2)n does not comprise an Fc region, wherein said (X2)n is either present or absent.

A method of making a DVD-Ig binding protein by pre-selecting the parent antibodies is provided. In an embodiment, the method of making a Dual Variable Domain Immunoglobulin that binds two antigens comprises the steps of a) obtaining a first parent antibody, or antigen binding portion thereof, that binds a first antigen; b) obtaining a second parent antibody or antigen binding portion thereof, that binds a second antigen; c) constructing first and third polypeptide chains, each of which comprises VD1-(X1)n-VD2-C—(X2)n, wherein VD1 is a first heavy chain variable domain obtained from said first parent antibody, or antigen binding portion thereof; VD2 is a second heavy chain variable domain obtained from said second parent antibody or antigen binding portion thereof, which can be the same as or different from the first parent antibody; C is a heavy chain constant domain; (X1)n is a linker with the proviso that it is not CH1, wherein said (X1)n is either present or absent; and (X2)n is an Fc region, wherein said (X2)n is either present or absent; d) constructing second and fourth polypeptide chains each of which comprises VD1-(X1)n-VD2-C—(X2)n, wherein, VD1 is a first light chain variable domain obtained from said first parent antibody, or antigen binding portion thereof; VD2 is a second light chain variable domain obtained from said second parent antibody, or antigen binding thereof, which can be the same as or different from the first parent antibody; C is a light chain constant domain; (X1)n is a linker with the proviso that it is not CH1, wherein said (X1)n is either present or absent; and (X2)n does not comprise an Fc region, wherein said (X2)n is either present or absent; and e) expressing said first, second, third and fourth polypeptide chains; such that a DVD-Ig binds said first antigen and said second antigen is generated.

In still another embodiment, a method of generating a DVD-Ig that binds two antigens with desired properties comprising the steps of a) obtaining a first parent antibody, or antigen binding portion thereof, that binds a first antigen and possessing at least one desired property exhibited by the DVD-Ig; b) obtaining a second parent antibody, or antigen binding portion thereof, which can be the same as or different from the first parent antibody, can bind to a second antigen and possesses at least one desired property exhibited by the Dual Variable Domain Immunoglobulin; c) constructing first and third polypeptide chains comprising VD1-(X1)n-VD2-C—(X2)n, wherein; VD1 is a first heavy chain variable domain obtained from said first parent antibody, or antigen binding portion thereof; VD2 is a second heavy chain variable domain obtained from said second parent antibody, or antigen binding portion thereof; C is a heavy chain constant domain; (X1)n is a linker with the proviso that it is not CH1, wherein said (X1)n is either present or absent; and (X2)n is an Fc region, wherein said (X2)n is either present or absent; d) constructing second and fourth polypeptide chains comprising VD1-(X1)n-VD2-C—(X2)n, wherein; VD1 is a first light chain variable domain obtained from said first parent antibody, or antigen binding portion thereof; VD2 is a second light chain variable domain obtained from said second parent antibody, or antigen binding portion thereof), which can be the same as or different from the first parent antibody; C is a light chain constant domain; (X1)n is a linker with the proviso that it is not CH1, wherein said (X1)n is either present or absent; and (X2)n does not comprise an Fc region, wherein said (X2)n is either present or absent; e) expressing said first, second, third and fourth polypeptide chains; such that a Dual Variable Domain Immunoglobulin capable of binding said first and said second antigen with desired properties is generated is provided.

In one embodiment, the VDI of the first and second polypeptide chains disclosed herein are obtained from the same parent antibody or antigen binding portion thereof. In another embodiment, the VDI of the first and second polypeptide chains disclosed herein are obtained from different parent antibodies or antigen binding portions thereof. In another embodiment, the VD2 of the first and second polypeptide chains disclosed herein are obtained from the same parent antibody or antigen binding portion thereof. In another embodiment, the VD2 of the first and second polypeptide chains disclosed herein are obtained from different parent antibodies or antigen binding portions thereof.

In one embodiment the first parent antibody or antigen binding portion thereof, and the second parent antibody or antigen binding portion thereof, are the same antibody. In another embodiment the first parent antibody or antigen binding portion thereof, and the second parent antibody or antigen binding portion thereof, are different antibodies.

In one embodiment the first parent antibody or antigen binding portion thereof, binds a first antigen and the second parent antibody or antigen binding portion thereof, binds a second antigen. In a particular embodiment, the first and second antigens are the same antigen. In another embodiment, the parent antibodies bind different epitopes on the same antigen. In another embodiment the first and second antigens are different antigens. In another embodiment, the first parent antibody or antigen binding portion thereof, binds the first antigen with a potency different from the potency with which the second parent antibody or antigen binding portion thereof, binds the second antigen. In yet another embodiment, the first parent antibody or antigen binding portion thereof, binds the first antigen with an affinity different from the affinity with which the second parent antibody or antigen binding portion thereof, binds the second antigen.

In another embodiment the first parent antibody or antigen binding portion thereof, and the second parent antibody or antigen binding portion thereof, are human antibodies, CDR grafted antibodies, or humanized antibodies. In an embodiment, the antigen binding portions are Fab fragments, F(ab')$_2$ fragments, bivalent fragments comprising two Fab fragments linked by a disulfide bridge at the hinge region, Fd fragments consisting of the VH and CH1 domains; Fv fragments consisting of the VL and VH domains of a single arm of an antibody, dAb fragments, isolated complementarity determining regions (CDR), single chain antibodies, or diabodies.

In another embodiment, the binding protein possesses at least one desired property exhibited by the first parent antibody or antigen binding portion thereof, or the second parent antibody or antigen binding portion thereof. Alternatively, the first parent antibody or antigen binding portion thereof and the second parent antibody or antigen binding portion thereof possess at least one desired property exhibited by the Dual Variable Domain Immunoglobulin. In an embodiment, the desired property is selected from one or more antibody parameters. In another embodiment, the antibody parameters are antigen specificity, affinity to antigen, potency, biological function, epitope recognition, stability, solubility, production efficiency, immunogenicity, pharmacokinetics, bioavailability, tissue cross reactivity, or orthologous antigen binding. In an embodiment the binding protein is multivalent. In another embodiment, the binding protein is multispecific. The multivalent and or multispecific binding proteins described herein have desirable properties particularly from a therapeutic standpoint. For instance, the multivalent and or multispecific binding protein may (1) be internalized (and/or catabolized) faster than a bivalent antibody by a cell expressing an antigen to which the antibodies bind; (2) be an agonist antibody; and/or (3) induce cell death and/or apoptosis of a cell expressing an antigen to which the multivalent antibody binds. The "parent antibody," which provides at least one antigen binding specificity of the multivalent and/or multispecific binding proteins, may be one which is internalized (and/or catabolized) by a cell expressing an antigen to which the antibody binds; and/or may be an agonist, cell death-inducing, and/or apoptosis-inducing antibody, and the multivalent and or multispecific binding protein as described herein may display improvement(s) in one or more of these properties. Moreover, the parent antibody may lack any one or more of these properties, but may be endowed with them when constructed as a multivalent binding protein as described herein.

In another embodiment, the binding protein has an on rate constant (Kon) to one or more targets of: at least about $10^2 M^{-1} s^{-1} s^{-1}$; at least about $10^3 M^{-1} s^{-1}$; at least about at least about $10^5 M^{-1} s^{-1}$; or at least about $10^6 M^{-1} s^{-1}$, as measured by surface plasmon resonance. In an embodiment, the binding protein has an on rate constant (Kon) to one or more targets between about $10^2 M^{-1} s^{-1}$ and about $10^3 M^{-1} s^{-1}$; between about $10^3 M^{-1} s^{-1}$ and about $10^4 M^{-1} s^{-1}$; between about $10^4 M^{-1} s^{-1}$ and about $10^5 M^{-1} s^{-1}$; or between about $10^5 M^{-1} s^{-1}$ and about $10^6 M^{-1} s^{-1}$, as measured by surface plasmon resonance.

In another embodiment the binding protein has an off rate constant (Koff) for one or more targets of: at most about $10^{-3}$ s$^{-1}$; at most about $10^{-4}$ s$^{-1}$; at most about $10^{-5}$ s$^{-1}$; or at most about $10^{-6}$ s$^{-1}$, as measured by surface plasmon resonance. In an embodiment, the binding protein has an off rate constant (Koff) to one or more targets of from about $10^{-3}$ s$^{-1}$ to about $10^{-4}$ s$^{-1}$; of from about $10^{-4}$ s$^{-1}$ to about $10^{-5}$ s$^{-1}$; or of from about $10^{-5}$ s$^{-1}$ to about $10^{-6}$ s$^{-1}$, as measured by surface plasmon resonance.

In another embodiment the binding protein has a dissociation constant (K$_D$) to one or more targets of: at most about $10^{-7}$M; at most about $10^{-8}$M; at most about $10^{-9}$M; at most about $10^{-10}$M at most about $10^{-11}$M; at most about $10^{-12}$M; or at most about $10^{-13}$M. In an embodiment, the binding protein has a dissociation constant (K$_D$) to its targets of from about $10^{-7}$M to about $10^{-8}$M; of from about $10^{-8}$M to about $10^{-9}$M; of from about $10^{-9}$M to about $10^{-10}$M of from about $10^{-10}$M to about $10^{-11}$M; of from about $10^{-11}$M to about $10^{-12}$M; or of from about $10^{-12}$M to about $10^{-13}$M.

In another embodiment, the binding protein described herein is a conjugate further comprising an agent. In some embodiments, the agent is an immunoadhesion molecule, an imaging agent, a therapeutic agent, or a cytotoxic agent. In an embodiment, the imaging agent is a radiolabel, an enzyme, a fluorescent label, a luminescent label, a bioluminescent label, a magnetic label, or biotin. In another embodiment, the radiolabel is: $^3$H, $^{14}$C, $^{35}$S, $^{90}$Y, $^{99}$Tc, $^{111}$In, $^{125}$I, $^{131}$I, $^{177}$Lu, $^{166}$Ho, or $^{153}$Sm. In yet another embodiment, the therapeutic or cytotoxic agent is an anti-metabolite, an alkylating agent, an antibiotic, a growth factor, a cytokine, an anti-angiogenic agent, an anti-mitotic agent, an anthracycline, toxin, or an apoptotic agent.

In another embodiment, the binding protein described herein is a crystallized binding protein and exists as a crystal. In an embodiment, the crystal is a carrier-free pharmaceutical controlled release crystal. In yet another embodiment, the crystallized binding protein has a greater half life in vivo than the soluble counterpart of said binding protein. In still another embodiment, the crystallized binding protein retains biological activity.

In another embodiment, the binding protein described herein is glycosylated. For example, the glycosylation is a human glycosylation pattern.

An isolated nucleic acid encoding any one of the binding proteins disclosed herein is provided. A further embodiment provides a vector comprising the isolated nucleic acid disclosed herein wherein said vector is pcDNA; pTT (Durocher et al. (2002) Nucl. Acids Res. 30: 2); pTT3 (pTT with additional multiple cloning site; pEFBOS (Mizushima, S, and Nagata, S. (1990) Nucl. Acids Res. 18: 17); pBV; pJV; pcDNA3.1 TOPO; pEF6 TOPO; or pBJ. In an embodiment, the vector is a vector disclosed in U.S. Patent Publication No. 2009/0239259.

In another aspect a host cell is transformed with the vector disclosed herein. In an embodiment, the host cell is a prokaryotic cell. In another embodiment, the host cell is *E. coli*. In a related embodiment the host cell is a eukaryotic cell. In another embodiment, the eukaryotic cell is a protist cell, an animal cell, a plant cell, or a fungal cell. In yet another embodiment, the host cell is a mammalian cell including, but not limited to, CHO, COS; NS0, SP2, PER.C6 or a fungal cell, such as *Saccharomyces cerevisiae*; or an insect cell such as Sf9.

In an embodiment, two or more DVD-Igs, e.g., with different specificities, are produced in a single recombinant host cell. For example, the expression of a mixture of antibodies has been called Oligoclonics™ (Merus B. V., The Netherlands); U.S. Pat. Nos. 7,262,028; 7,429,486.

A method of producing a binding protein disclosed herein comprising culturing any one of the host cells also disclosed herein in a culture medium under conditions sufficient to produce the binding protein is provided. In an embodiment, 50%-75% of the binding protein produced by this method is a dual specific tetravalent binding protein. In a particular embodiment, 75%-90% of the binding protein produced by this method is a dual specific tetravalent binding protein. In a particular embodiment, 90%-95% of the binding protein produced is a dual specific tetravalent binding protein.

One embodiment provides a composition for the release of a binding protein wherein the composition comprises a formulation that in turn comprises a crystallized binding protein, as disclosed herein, and an ingredient, and at least one polymeric carrier. In another embodiment, the polymeric carrier comprises one or more polymers. In some embodiments, the polymers are poly (acrylic acid), poly (cyanoacrylates), poly (amino acids), poly (anhydrides), poly (depsipeptide), poly (esters), poly (lactic acid), poly (lactic-co-glycolic acid) or PLGA, poly (b-hydroxybutryate), poly (caprolactone), poly (dioxanone); poly (ethylene glycol), poly ((hydroxypropyl)methacrylamide, poly [(organo)phosphazene], poly (ortho esters), poly (vinyl alcohol), poly (vinylpyrrolidone), maleic anhydride-alkyl vinyl ether copolymers, pluronic polyols, albumin, alginate, cellulose and cellulose derivatives, collagen, fibrin, gelatin, hyaluronic acid, oligosaccharides, glycaminoglycans, sulfated polysaccharides, or blends or copolymers thereof. In some embodiments, the ingredient is albumin, sucrose, trehalose, lactitol, gelatin, hydroxypropyl-β-cyclodextrin, methoxypolyethylene glycol or polyethylene glycol. Another embodiment provides a method for treating a mammal comprising the step of administering to the mammal an effective amount of the composition disclosed herein.

A pharmaceutical composition comprising a binding protein, as disclosed herein and a pharmaceutically acceptable carrier is provided. In a further embodiment the pharmaceutical composition comprises at least one additional therapeutic agent for treating a disorder. In some embodiments, the additional agent is: a therapeutic agent, an imaging agent, a cytotoxic agent, an angiogenesis inhibitor (including but not limited to an anti-VEGF antibody or a VEGF-trap), a kinase inhibitor (including but not limited to a KDR and a TIE-2 inhibitor), a co-stimulation molecule blocker (including but not limited to anti-B7.1, anti-B7.2, CTLA4-Ig, anti-CD20), an adhesion molecule blocker (including but not limited to an anti-LFA-1 antibody, an anti-E/L selectin antibody, a small molecule inhibitor), an anti-cytokine antibody or functional fragment thereof (including but not limited to an anti-IL-18, an anti-TNF, and an anti-IL-6/ cytokine receptor antibody), methotrexate, cyclosporin, rapamycin, FK506, a detectable label or reporter, a TNF antagonist, an antirheumatic, a muscle relaxant, a narcotic, a non-steroid anti-inflammatory drug (NSAID), an analgesic, an anesthetic, a sedative, a local anesthetic, a neuromuscular blocker, an antimicrobial, an antipsoriatic, a corticosteriod, an anabolic steroid, an erythropoietin, an immunization, an immunoglobulin, an immunosuppressive, a growth hormone, a hormone replacement drug, a radiopharmaceutical, an antidepressant, an antipsychotic, a stimulant, an asthma medication, a beta agonist, an inhaled steroid, an epinephrine or analog, a cytokine, or a cytokine antagonist.

A method for treating a human subject suffering from a disorder in which the target, or targets, that can be bound by the binding protein disclosed herein is/are detrimental, comprising administering to the human subject a binding protein disclosed herein such that the activity of the target, or targets in the human subject is inhibited and one of more symptoms is alleviated or treatment is achieved is provided. For example, the disorder is arthritis, osteoarthritis, juvenile chronic arthritis, septic arthritis, Lyme arthritis, psoriatic arthritis, reactive arthritis, spondyloarthropathy, systemic lupus erythematosus, Crohn's disease, ulcerative colitis, inflammatory bowel disease, insulin dependent diabetes mellitus, thyroiditis, asthma, allergic diseases, psoriasis, dermatitis scleroderma, graft versus host disease, organ transplant rejection, acute or chronic immune disease associated with organ transplantation, sarcoidosis, atherosclerosis, disseminated intravascular coagulation, Kawasaki's disease, Grave's disease, nephrotic syndrome, chronic fatigue syndrome, Wegener's granulomatosis, Henoch-Schoenlein purpurea, microscopic vasculitis of the kidneys, chronic active hepatitis, uveitis, septic shock, toxic shock syndrome, sepsis syndrome, cachexia, infectious diseases, parasitic diseases, acquired immunodeficiency syndrome, acute transverse myelitis, Huntington's chorea, Parkinson's disease, Alzheimer's disease, stroke, primary biliary cirrhosis, hemolytic anemia, malignancies, heart failure, myocardial infarction, Addison's disease, sporadic polyglandular deficiency type I and polyglandular deficiency type II, Schmidt's syndrome, adult (acute) respiratory distress syndrome, alopecia, alopecia areata, seronegative arthopathy, arthropathy, Reiter's disease, psoriatic arthropathy, ulcerative colitic arthropathy, enteropathic synovitis, chlamydia, *yersinia* and *salmonella* associated arthropathy, spondyloarthopathy, atheromatous disease/arteriosclerosis, atopic allergy, autoimmune bullous disease, pemphigus vulgaris, pemphigus foliaceus, pemphigoid, linear IgA disease, autoimmune haemolytic anaemia, Coombs positive haemolytic anaemia, acquired pernicious anaemia, juvenile pernicious anaemia, myalgic encephalitis/Royal Free Disease, chronic mucocutaneous candidiasis, giant cell arteritis, primary sclerosing hepatitis, cryptogenic autoimmune hepatitis, Acquired Immunodeficiency Disease Syndrome, Acquired Immunodeficiency Related Diseases, Hepatitis B, Hepatitis C, common varied immunodeficiency (common variable hypogammaglobulinaemia), dilated cardiomyopathy, female infertility, ovarian failure, premature ovarian failure, fibrotic lung disease, cryptogenic fibrosing alveolitis, post-inflammatory interstitial lung disease, interstitial pneumonitis, connective tissue disease associated interstitial lung disease, mixed connective tissue disease associated lung disease, systemic sclerosis associated interstitial lung disease, rheumatoid arthritis associated interstitial lung disease, systemic lupus erythematosus associated lung disease, dermatomyositis/polymyositis associated lung disease, Sjögren's disease associated lung disease, ankylosing spondylitis associated lung disease, vasculitic diffuse lung disease, haemosiderosis associated lung disease, drug-induced interstitial lung disease, fibrosis, radiation fibrosis, bronchiolitis obliterans, chronic eosinophilic pneumonia, lymphocytic infiltrative lung disease, postinfectious interstitial lung disease, gouty arthritis, autoimmune hepatitis, type-1 autoimmune hepatitis (classical autoimmune or lupoid hepatitis), type-2 autoimmune hepatitis (anti-LKM antibody hepatitis), autoimmune mediated hypoglycemia, type B insulin resistance with acanthosis nigricans, hypoparathyroidism, acute immune disease associated with organ transplantation, chronic immune disease associated with organ transplantation, osteoarthrosis, primary sclerosing cholangitis, psoriasis type 1, psoriasis type 2, idiopathic leucopaenia, autoimmune neutropaenia, renal disease NOS, glomerulonephritides, microscopic vasulitis of the kidneys, lyme disease, discoid lupus erythematosus, male infertility idiopathic or NOS, sperm autoimmunity, multiple sclerosis (all subtypes), sympathetic ophthalmia, pulmonary hypertension secondary to connective tissue disease, Goodpasture's syndrome, pulmonary manifestation of polyarteritis nodosa, acute rheumatic fever, rheumatoid spondylitis, Still's disease, systemic sclerosis, Sjörgren's syndrome, Takayasu's disease/arteritis, autoimmune thrombocytopaenia, idiopathic thrombocytopaenia, autoimmune thyroid disease, hyperthyroidism, goitrous autoimmune hypothyroidism (Hashimoto's disease), atrophic autoimmune hypothyroidism, primary myxoedema, phacogenic uveitis, primary vasculitis, vitiligo acute liver disease, chronic liver diseases, alcoholic cirrhosis, alcohol-induced liver injury, choleosatatis, idiosyncratic liver disease, Drug-Induced hepatitis, Non-alcoholic Steatohepatitis, allergy and asthma, group B streptococci (GBS) infection, mental disorders (e.g., depression and schizophrenia), Th2 Type and Th1 Type mediated diseases, acute and chronic pain (different forms of pain), and cancers such as lung, breast, stomach, bladder, colon, pancreas, ovarian, prostate and rectal cancer and hematopoietic malignancies (leukemia and lymphoma), Abetalipoprotemia, Acrocyanosis, acute and chronic parasitic or infectious processes, acute leukemia, acute lymphoblastic leukemia (ALL), acute myeloid leukemia (AML), acute or chronic bacterial infection, acute pancreatitis, acute renal failure, adenocarcinomas, aerial ectopic beats, AIDS dementia complex, alcohol-induced hepatitis, allergic conjunctivitis, allergic contact dermatitis, allergic rhinitis, allograft rejection, alpha-1-antitrypsin deficiency, amyotrophic lateral sclerosis, anemia, angina pectoris, anterior horn cell degeneration, anti cd3 therapy, antiphospholipid syndrome, anti-receptor hypersensitivity reactions, aortic and peripheral aneuryisms, aortic dissection, arterial hypertension, arteriosclerosis, arteriovenous fistula, ataxia, atrial fibrillation (sustained or paroxysmal), atrial flutter, atrioventricular block, B cell lymphoma, bone graft rejection, bone marrow transplant (BMT) rejection, bundle branch block, Burkitt's lymphoma, Burns, cardiac arrhythmias, cardiac stun syndrome, cardiac tumors, cardiomyopathy, cardiopulmonary bypass inflammation response, cartilage transplant rejection, cerebellar cortical degenerations, cerebellar disorders, chaotic or multifocal atrial tachycardia, chemotherapy associated disorders, chronic myelocytic leukemia (CML), chronic alcoholism, chronic inflammatory pathologies, chronic lymphocytic leukemia (CLL), chronic obstructive pulmonary disease (COPD), chronic salicylate intoxication, colorectal carcinoma, congestive heart failure, conjunctivitis, contact dermatitis, car pulmonale, coronary artery disease, Creutzfeldt-Jakob disease, culture negative sepsis, cystic fibrosis, cytokine therapy associated disorders, Dementia pugilistica, demyelinating diseases, dengue hemorrhagic fever, dermatitis, dermatologic conditions, diabetes, diabetes mellitus, diabetic ateriosclerotic disease, Diffuse Lewy body disease, dilated congestive cardiomyopathy, disorders of the basal ganglia, Down's Syndrome in middle age, drug-induced movement disorders induced by drugs which block CNS dopamine receptors, drug sensitivity, eczema, encephalomyelitis, endocarditis, endocrinopathy, epiglottitis, epstein-barr virus infection, erythromelalgia, extrapyramidal and cerebellar disorders, familial hematophagocytic lymphohistiocytosis, fetal thymus implant rejection, Friedreich's ataxia, functional peripheral arterial disorders, fungal sepsis, gas gangrene, gastric ulcer, glomerular nephritis, graft rejection of any organ or tissue, gram negative sepsis, gram positive sepsis, granulomas due to intracellular organisms, hairy cell leukemia, Hallerrorden-Spatz disease, hashimoto's thyroiditis, hay fever, heart transplant rejection, hemachromatosis, hemodialysis, hemolytic uremic syndrome/thrombolytic thrombocytopenic purpura, hemorrhage, hepatitis (A), His bundle arrythmias, HIV infection/HIV neuropathy, Hodgkin's disease, hyperkinetic movement disorders, hypersensitivity reactions, hypersensitivity pneumonitis, hypertension, hypokinetic movement disorders, hypothalamic-pituitary-adrenal axis evaluation, idiopathic Addison's disease, idiopathic pulmonary fibrosis, antibody mediated cytotoxicity, Asthenia, infantile spinal muscular atrophy, inflammation of the aorta, influenza a, ionizing radiation exposure, iridocyclitis/uveitis/optic neuritis, ischemia-reperfusion injury, ischemic stroke, juvenile rheumatoid arthritis, juvenile spinal muscular atrophy, Kaposi's sarcoma, kidney transplant rejection, *legionella*, leishmaniasis, leprosy, lesions of the corticospinal system, lipedema, liver transplant rejection, lymphederma, malaria, malignant Lymphoma, malignant histiocytosis, malignant melanoma, meningitis, meningococcemia, metabolic/idiopathic diseases, migraine headache, mitochondrial multi.system disorder, mixed connective tissue disease, monoclonal gammopathy, multiple myeloma, multiple systems degenerations (Mencel Dejerine-Thomas Shi-Drager and Machado-Joseph), myasthenia gravis, *mycobacterium avium* intracellulare, *mycobacterium tuberculosis*, myelodyplastic syndrome, myocardial infarction, myocardial ischemic disorders, nasopharyngeal carcinoma, neonatal chronic lung disease, nephritis, nephrosis, neurodegenerative diseases, neurogenic I muscular atrophies, neutropenic fever, non-hodgkins lymphoma, occlusion of the abdominal aorta and its branches, occlusive arterial disorders, okt3 therapy, orchitis/epidydimitis, orchitis/vasectomy reversal procedures, organomegaly, osteoporosis, pancreas transplant rejection, pancreatic carcinoma, paraneoplastic syndrome/hypercalcemia of malignancy, parathyroid transplant rejection, pelvic inflammatory disease, perennial rhinitis, pericardial disease, peripheral atherlosclerotic disease, peripheral vascular disorders, peritonitis, pernicious anemia, *pneumocystis carinii* pneumonia, pneumonia, POEMS syndrome (polyneuropathy, organomegaly, endocrinopathy, monoclonal gammopathy, and skin changes syndrome), post perfusion syndrome, post pump syndrome, post-MI cardiotomy syndrome, preeclampsia, Progressive supranucleo Palsy, primary pulmonary hypertension, radiation therapy, Raynaud's phenomenon and disease, Raynaud's disease, Refsum's disease, regular narrow QRS tachycardia, renovascular hypertension, reperfusion injury, restrictive cardiomyopathy, sarcomas, scleroderma, senile chorea, Senile Dementia of Lewy body type, seronegative arthropathies, shock, sickle cell anemia, skin allograft rejection, skin changes syndrome, small bowel transplant rejection, solid tumors, specific arrythmias, spinal ataxia, spinoerebellar degenerations, streptococcal myositis, structural lesions of the cerebellum, Subacute sclerosing panencephalitis, Syncope, syphilis of the cardiovascular system, systemic anaphalaxis, systemic inflammatory response syndrome, systemic onset juvenile rheumatoid arthritis, T-cell or FAB ALL, Telangiectasia, thromboangitis obliterans, thrombocytopenia, toxicity, transplants, trauma/hemorrhage, type III hypersensitivity reactions, type IV hypersensitivity, unstable angina, uremia, urosepsis, urticaria, valvular heart diseases, varicose veins, vasculitis, venous diseases, venous thrombosis, ventricular fibrillation, viral and fungal infections, vital encephalitis/aseptic meningitis, vital-associated hemaphagocytic syndrome, Wernicke-Korsakoff syndrome, Wilson's disease, xenograft rejection of any organ or tissue, acute coronary syndromes, acute idiopathic polyneuritis, acute inflammatory demyelinating polyradiculoneuropathy, acute ischemia, adult Still's disease, alopecia areata, anaphylaxis, anti-phospholipid antibody syndrome, aplastic anemia, arteriosclerosis, atopic eczema, atopic dermatitis, autoimmune dermatitis, autoimmune disorder associated with *streptococcus* infection, autoimmune enteropathy, autoimmune hearing loss, autoimmune lymphoproliferative syndrome (ALPS), autoimmune myocarditis, autoimmune premature ovarian failure, blepharitis, bronchiectasis, bullous pemphigoid, cardiovascular disease, catastrophic antiphospholipid syndrome, celiac disease, cervical spondylosis, chronic ischemia, cicatricial pemphigoid, clinically isolated syndrome (cis) with risk for multiple sclerosis, conjunctivitis, childhood onset psychiatric disorder, chronic obstructive pulmonary disease (COPD), dacryocystitis, dermatomyositis, diabetic retinopathy, diabetes mellitus, disk herniation, disk prolaps, drug induced immune hemolytic anemia, endocarditis, endometriosis, endophthalmitis, episcleritis, erythema multiforme, erythema multiforme major, gestational pemphigoid, Guillain-Barré syndrome (GBS), hay fever, Hughes syndrome, idiopathic Parkinson's disease, idiopathic interstitial pneumonia, IgE-mediated allergy, immune hemolytic anemia, inclusion body myositis, infectious ocular inflammatory disease, inflammatory demyelinating disease, inflammatory heart disease, inflammatory kidney disease, IPF/UIP, iritis, keratitis, keratojuntivitis sicca, Kussmaul disease or Kussmaul-Meier disease, Landry's paralysis, Langerhan's cell histiocytosis, livedo reticularis, macular degeneration, microscopic polyangiitis, morbus bechterev, motor neuron disorders, mucous membrane pemphigoid, multiple organ failure, myasthenia gravis, myelodysplastic syndrome, myocarditis, nerve root disorders, neuropathy, non-A non-B hepatitis, optic neuritis, osteolysis, ovarian cancer, pauciarticular JRA, peripheral artery occlusive disease (PAOD), peripheral vascular disease (PVD), peripheral artery, disease (PAD), phlebitis, polyarteritis nodosa (or periarteritis nodosa), polychondritis, polymyalgia rheumatica, poliosis, polyarticular JRA, polyendocrine deficiency syndrome, polymyositis, polymyalgia rheumatica (PMR), post-pump syndrome, primary Parkinsonism, prostate and rectal cancer and hematopoietic malignancies (leukemia and lymphoma), prostatitis, pure red cell aplasia, primary adrenal insufficiency, recurrent neuromyelitis optica, restenosis, rheumatic heart disease, SAPHO (synovitis, acne, pustulosis, hyperostosis, and osteitis), scleroderma, secondary amyloidosis, shock lung, scleritis, sciatica, secondary adrenal insufficiency, silicone associated connective tissue disease, sneddon-wilkinson dermatosis, spondilitis ankylosans, Stevens-Johnson syndrome (SJS), systemic inflammatory response syndrome, temporal arteritis, toxoplasmic retinitis, toxic epidermal necrolysis, transverse myelitis, TRAPS (tumor necrosis factor receptor, type 1 allergic reaction, type II diabetes, urticaria, usual interstitial pneumonia (UIP), vasculitis, vernal conjunctivitis, viral retinitis, Vogt-Koyanagi-Harada syndrome (VKH syndrome), wet macular degeneration, wound healing, *yersinia* and *salmonella* associated arthropathy.

In an embodiment, diseases that can be treated or diagnosed with the compositions and methods provided include, but are not limited to, primary and metastatic cancers, including carcinomas of breast, colon, rectum, lung, oropharynx, hypopharynx, esophagus, stomach, pancreas, liver, gallbladder and bile ducts, small intestine, urinary tract (including kidney, bladder and urothelium), female genital tract (including cervix, uterus, and ovaries as well as choriocarcinoma and gestational trophoblastic disease), male genital tract (including prostate, seminal vesicles, testes and germ cell tumors), endocrine glands (including the thyroid, adrenal, and pituitary glands), and skin, as well as hemangiomas, melanomas, sarcomas (including those arising from bone and soft tissues as well as Kaposi's sarcoma), tumors of the brain, nerves, eyes, and meninges (including astrocytomas, gliomas, glioblastomas, retinoblastomas, neuromas, neuroblastomas, Schwannomas, and meningiomas), solid tumors arising from hematopoietic malignancies such as leukemias, and lymphomas (both Hodgkin's and non-Hodgkin's lymphomas).

In an embodiment, the antibodies provided or antigen-binding portions thereof, are used to treat cancer or in the prevention or inhibition of metastases from the tumors described herein either when used alone or in combination with radiotherapy and/or other chemotherapeutic agents.

A method of treating a patient suffering from a disorder comprising the step of administering any one of the binding proteins disclosed herein before, concurrently, or after the administration of a second agent, as discussed herein is provided. In a particular embodiment the second agent is budenoside, epidermal growth factor, corticosteroids, cyclosporin, sulfasalazine, aminosalicylates, 6-mercaptopurine, azathioprine, metronidazole, lipoxygenase inhibitors, mesalamine, olsalazine, balsalazide, antioxidants, thromboxane inhibitors, IL-1 receptor antagonists, anti-IL-1β mAbs, anti-IL-6 or IL-6 receptor mAbs, growth factors, elastase inhibitors, pyridinyl-imidazole compounds, antibodies or agonists of TNF, LT, IL-1, IL-2, IL-6, IL-7, IL-8, IL-12, IL-13, IL-15, IL-16, IL-18, IL-23, EMAP-II, GM-CSF, FGF, and PDGF, antibodies of CD2, CD3, CD4, CD8, CD-19, CD25, CD28, CD30, CD40, CD45, CD69, CD90 or their ligands, methotrexate, cyclosporin, FK506, rapamycin, mycophenolate mofetil, leflunomide, NSAIDs, ibuprofen, corticosteroids, prednisolone, phosphodiesterase inhibitors, adenosine agonists, antithrombotic agents, complement inhibitors, adrenergic agents, IRAK, NIK, IKK, p38, MAP kinase inhibitors, IL-1β converting enzyme inhibitors, TNFα converting enzyme inhibitors, T-cell signalling inhibitors, metalloproteinase inhibitors, sulfasalazine, azathioprine, 6-mercaptopurines, angiotensin converting enzyme inhibitors, soluble cytokine receptors, soluble p55 TNF receptor, soluble p75 TNF receptor, sIL-1RI, sIL-1RII, sIL-6R, antiinflammatory cytokines, IL-4, IL-10, IL-11, IL-13, or TGFβ.

In a particular embodiment the pharmaceutical compositions disclosed herein are administered to the patient by at least one mode selected from parenteral, subcutaneous, intramuscular, intravenous, intrarticular, intrabronchial, intraabdominal, intracapsular, intracartilaginous, intracavitary, intracelial, intracerebellar, intracerebroventricular, intracolic, intracervical, intragastric, intrahepatic, intramyocardial, intraosteal, intrapelvic, intrapericardiac, intraperitoneal, intrapleural, intraprostatic, intrapulmonary, intrarectal, intrarenal, intraretinal, intraspinal, intrasynovial, intrathoracic, intrauterine, intravesical, bolus, vaginal, rectal, buccal, sublingual, intranasal, and transdermal.

At least one anti-idiotypic antibody to at least one binding protein provided herein is also provided. The anti-idiotypic antibody includes any protein or peptide containing molecule that comprises at least a portion of an immunoglobulin molecule such as, but not limited to, at least one complementarily determining region (CDR) of a heavy or light chain or a ligand binding portion thereof, a heavy chain or light chain variable region, a heavy chain or light chain constant region, a framework region, or any portion thereof, that can be incorporated into a binding protein provided herein.

DETAILED DESCRIPTION

Figure 1:
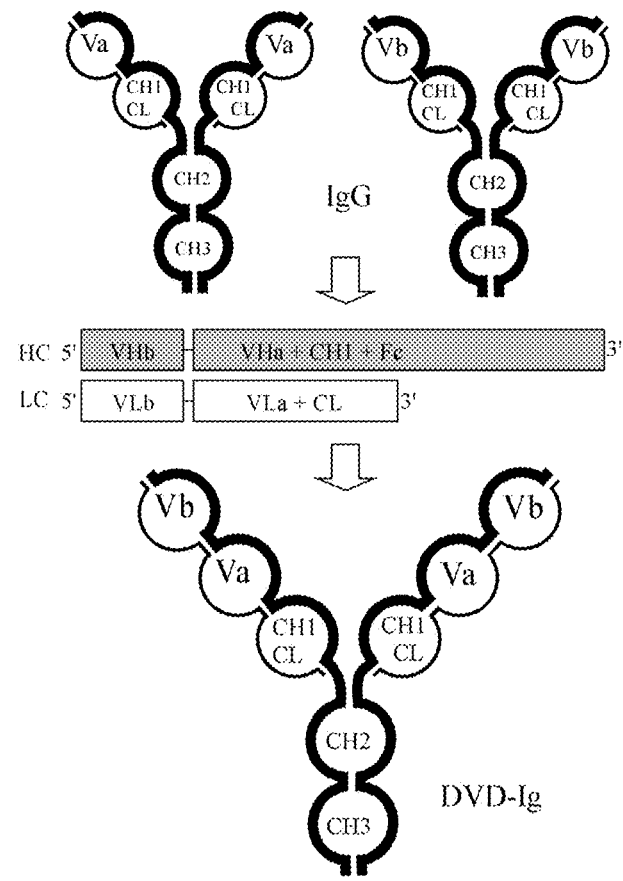
FIG. 1A is a schematic representation of Dual Variable Domain (DVD)-Ig constructs and shows the strategy for generation of a DVD-Ig from two parent antibodies.
FIG. 1B, is a schematic representation of constructs DVD1-Ig, DVD2-Ig, and two chimeric mono-specific antibodies from hybridoma clones 2D13.E3 (anti-IL-1α) and 13F5.G5 (anti-IL-1β).
Figure 1:
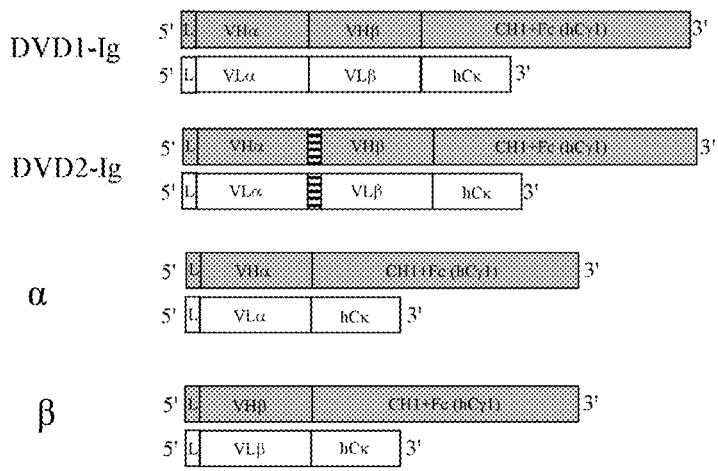

Multivalent and/or multispecific binding proteins that bind two or more antigens are provided. Specifically, dual variable domain immunoglobulins (DVD-Ig), and pharmaceutical compositions thereof, as well as nucleic acids, recombinant expression vectors and host cells for making such DVD-Igs are provided. Methods of using the DVD-Igs to detect specific antigens, either in vitro or in vivo are also provided.

Unless otherwise defined herein, scientific and technical terms used herein shall have the meanings that are commonly understood by those of ordinary skill in the art. The meaning and scope of the terms should be clear, however, in the event of any latent ambiguity, definitions provided herein take precedent over any dictionary or extrinsic definition. Further, unless otherwise required by context, singular terms shall include pluralities and plural terms shall include the singular. In this application, the use of "or" means "and/or" unless stated otherwise. Furthermore, the use of the term "including," as well as other forms, such as "includes" and "included," is not limiting. Also, terms such as "element" or "component" encompass both elements and components comprising one unit and elements and components that comprise more than one subunit unless specifically stated otherwise.

Generally, nomenclatures used in connection with, and techniques of, cell and tissue culture, molecular biology, immunology, microbiology, genetics and protein and nucleic acid chemistry and hybridization described herein are those well known and commonly used in the art. The methods and techniques discussed herein are generally performed according to conventional methods well known in the art and as described in various general and more specific references that are cited and discussed throughout the present specification unless otherwise indicated. Enzymatic reactions and purification techniques are performed according to manufacturers specifications, as commonly accomplished in the art or as described herein. The nomenclatures used in connection with, and the laboratory procedures and techniques of, analytical chemistry, synthetic organic chemistry, and medicinal and pharmaceutical chemistry described herein are those well known and commonly used in the art. Standard techniques are used for chemical syntheses, chemical analyses, pharmaceutical preparation, formulation, and delivery, and treatment of patients.

Select terms are defined below:

The term "polypeptide" as used herein, refers to any polymeric chain of amino acids. The terms "peptide" and "protein" are used interchangeably with the term polypeptide and also refer to a polymeric chain of amino acids. The term "polypeptide" encompasses native or artificial proteins, protein fragments and polypeptide analogs of a protein sequence. A polypeptide may be monomeric or polymeric. Use of "polypeptide" herein is intended to encompass polypeptide and fragments and variants (including fragments of variants) thereof, unless otherwise stated. For an antigenic polypeptide, a fragment of polypeptide optionally contains at least one contiguous or nonlinear epitope of polypeptide. The precise boundaries of the at least one epitope fragment can be confirmed using ordinary skill in the art. The fragment comprises at least about 5 contiguous amino acids, such as at least about 10 contiguous amino acids, at least about 15 contiguous amino acids, or at least about 20 contiguous amino acids. A variant of polypeptide is as described herein.

The term "isolated protein" or "isolated polypeptide" is a protein or polypeptide that by virtue of its origin or source of derivation is not associated with naturally associated components that accompany it in its native state; is substantially free of other proteins from the same species; is expressed by a cell from a different species; or does not occur in nature. Thus, a polypeptide that is chemically synthesized or synthesized in a cellular system different from the cell from which it naturally originates will be "isolated" from its naturally associated components. A protein may also be rendered substantially free of naturally associated components by isolation, using protein purification techniques well known in the art.

The term "recovering" as used herein, refers to the process of rendering a chemical species such as a polypeptide substantially free of naturally associated components by isolation, e.g., using protein purification techniques well known in the art.

"Biological activity" as used herein, refers to any one or more inherent biological properties of a molecule (whether present naturally as found in vivo, or provided or enabled by recombinant means). Biological properties include but are not limited to binding a receptor; inducing cell proliferation, inhibiting cell growth, inducing other cytokines, inducing apoptosis, and enzymatic activity. Biological activity also includes activity of an Ig molecule.

The terms "specific binding" or "specifically binding," as used herein, in reference to the interaction of an antibody, a protein, or a peptide with a second chemical species, mean that the interaction is dependent upon the presence of a particular structure (e.g., an antigenic determinant or epitope) on the chemical species; for example, an antibody recognizes and binds to a specific protein structure rather than to proteins generally. If an antibody is specific for epitope "A," the presence of a molecule containing epitope A (or free, unlabeled A), in a reaction containing labeled "A" and the antibody, will reduce the amount of labeled A bound to the antibody.

The term "antibody," as used herein, broadly refers to any immunoglobulin (Ig) molecule comprised of four polypeptide chains, two heavy (H) chains and two light (L) chains, or any functional fragment, mutant, variant, or derivation thereof, which retains the essential epitope binding features of an Ig molecule. Such mutant, variant, or derivative antibody formats are known in the art. Nonlimiting embodiments of which are discussed below.

In a full-length antibody, each heavy chain is comprised of a heavy chain variable region (abbreviated herein as HCVR or VH) and a heavy chain constant region. The heavy chain constant region is comprised of three domains, CH1, CH2 and CH3. Each light chain is comprised of a light chain variable region (abbreviated herein as LCVR or VL) and a light chain constant region. The light chain constant region is comprised of one domain, CL. The VH and VL regions can be further subdivided into regions of hypervariability, termed complementarity determining regions (CDR), interspersed with regions that are more conserved, termed framework regions (FR). Each VH and VL is composed of three CDRs and four FRs, arranged from amino-terminus to carboxy-terminus in the following order: FR1, CDR1, FR2, CDR2, FR3, CDR3, and FR4. Immunoglobulin molecules can be of any type (e.g., IgG, IgE, IgM, IgD, IgA and IgY), class (e.g., IgG 1, IgG2, IgG 3, IgG4, IgA1 and IgA2) or subclass.

The term "Fc region" is used to define the C-terminal region of an immunoglobulin heavy chain, which may be generated by papain digestion of an intact antibody. The Fc region may be a native sequence Fc region or a variant Fc region. The Fc region of an immunoglobulin generally comprises two constant domains, a CH2 domain and a CH3 domain, and optionally comprises a CH4 domain. Replacements of amino acid residues in the Fc portion to alter antibody effector function are known in the art (U.S. Pat. Nos. 5,648,260 and 5,624,821). The Fc portion of an antibody mediates several important effector functions e.g., cytokine induction, ADCC, phagocytosis, complement dependent cytotoxicity (CDC) and half-life/clearance rate of antibody and antigen-antibody complexes. In some cases these effector functions are desirable for a therapeutic antibody but in other cases might be unnecessary or even deleterious, depending on the therapeutic objectives. Certain human IgG isotypes, particularly IgG1 and IgG3, mediate ADCC and CDC via binding to FcγRs and complement C1q, respectively. Neonatal Fc receptors (FcRn) are the critical components determining the circulating half-life of antibodies. In still another embodiment at least one amino acid residue is replaced in the constant region of the antibody, for example the Fc region of the antibody, such that effector functions of the antibody are altered. The dimerization of two identical heavy chains of an immunoglobulin is mediated by the dimerization of CH3 domains and is stabilized by the disulfide bonds within the hinge region (Huber et al. (1976) Nature 264: 415-20; Thies et al. (1999) J. Mol. Biol. 293: 67-79). Mutation of cysteine residues within the hinge regions to prevent heavy chain-heavy chain disulfide bonds will destabilize dimeration of CH3 domains. Residues responsible for CH3 dimerization have been identified (Dall'Acqua (1998) Biochem. 37: 9266-73). Therefore, it is possible to generate a monovalent half-Ig. Interestingly, these monovalent half Ig molecules have been found in nature for both IgG and IgA subclasses (Seligman (1978) Ann. Immunol. 129: 855-70; Biewenga et al. (1983) Clin. Exp. Immunol. 51: 395-400). The stoichiometry of FcRn:Ig Fc region has been determined to be 2:1 (West et al. (2000) Biochem. 39: 9698-708), and half Fc is sufficient for mediating FcRn binding (Kim et al. (1994) Eur. J. Immunol. 24: 542-548). Mutations to disrupt the dimerization of CH3 domain may not have greater adverse effect on its FcRn binding as the residues important for CH3 dimerization are located on the inner interface of CH3 b sheet structure, whereas the region responsible for FcRn binding is located on the outside interface of CH2-CH3 domains. However, the half-Ig molecule may have certain advantages in tissue penetration due to its smaller size in comparison to that of a regular antibody. In one embodiment at least one amino acid residue is replaced in the constant region of the binding protein provided herein, for example the Fc region, such that the dimerization of the heavy chains is disrupted, resulting in half DVD Ig molecules. The anti-inflammatory activity of IgG is completely dependent on sialylation of the N-linked glycan of the IgG Fc fragment. The precise glycan requirements for anti-inflammatory activity has been determined, such that an appropriate IgG1 Fc fragment can be created, thereby generating a fully recombinant, sialylated IgG1 Fc with greatly enhanced potency (Anthony, R. M., et al. (2008) Science 320: 373-376).

The term "antigen-binding portion" of an antibody (or simply "antibody portion"), as used herein, refers to one or more fragments of an antibody that retain the ability to bind specifically to an antigen. It has been shown that the antigen-binding function of an antibody can be performed by fragments of a full-length antibody. Such antibody embodiments may also be bispecific, dual specific, or multispecific formats; specifically binding to two or more different antigens. Examples of binding fragments encompassed within the term "antigen-binding portion" of an antibody include (i) a Fab fragment, a monovalent fragment consisting of the VL, VH, CL and CH1 domains; (ii) a F(ab')$_2$ fragment, a bivalent fragment comprising two Fab fragments linked by a disulfide bridge at the hinge region; (iii) a Fd fragment consisting of the VH and CH1 domains; (iv) a Fv fragment consisting of the VL and VH domains of a single arm of an antibody, (v) a dAb fragment (Ward (1989) Nature 341:544-546; PCT Publication No. WO 90/05144 A1), which comprises a single variable domain; and (vi) an isolated complementarity determining region (CDR). Furthermore, although the two domains of the Fv fragment, VL and VH, are coded for by separate genes, they can be joined, using recombinant methods, by a synthetic linker that enables them to be made as a single protein chain in which the VL and VH regions pair to form monovalent molecules (known as single chain Fv (scFv); see e.g., Bird et al. (1988) Science 242: 423-426; and Huston et al. (1988) Proc. Natl. Acad. Sci. USA 85: 5879-5883). Such single chain antibodies are also intended to be encompassed within the term "antigen-binding portion" of an antibody. Other forms of single chain antibodies, such as diabodies are also encompassed. Diabodies are bivalent, bispecific antibodies in which VH and VL domains are expressed on a single polypeptide chain, but using a linker that is too short to allow for pairing between the two domains on the same chain, thereby forcing the domains to pair with complementary domains of another chain and creating two antigen binding sites (see e.g., Holliger, P., et al. (1993) Proc. Natl. Acad. Sci. USA 90:6444-6448; Poljak, R. J., et al. (1994) Structure 2: 1121-1123). Such antibody binding portions are known in the art (Kontermann and Dubel eds., Antibody Engineering (2001) Springer-Verlag. New York. p. 790 (ISBN 3-540-41354-5). In addition single chain antibodies also include "linear antibodies" comprising a pair of tandem Fv segments (VH—CH1-VH—CH1) which, together with complementary light chain polypeptides, form a pair of antigen binding regions (Zapata et al. (1995) Protein Eng. 8(10):1057-1062; and U.S. Pat. No. 5,641,870).

The term "multivalent binding protein" is used throughout this specification to denote a binding protein comprising two or more antigen binding sites. In an embodiment, the multivalent binding protein is engineered to have the three or more antigen binding sites, and is generally not a naturally occurring antibody. The term "multispecific binding protein" refers to a binding protein that binds two or more related or unrelated targets. Dual variable domain (DVD) binding proteins provided herein comprise two or more antigen binding sites and are tetravalent or multivalent binding proteins. DVDs may be monospecific, i.e., bind one antigen or multispecific, i.e., capable of binding two or more antigens. DVD binding proteins comprising two heavy chain DVD polypeptides and two light chain DVD polypeptides are referred to as DVD-Ig. Each half of a DVD-Ig comprises a heavy chain DVD polypeptide, and a light chain DVD polypeptide, and two antigen binding sites. Each binding site comprises a heavy chain variable domain and a light chain variable domain with a total of 6 CDRs involved in antigen binding per antigen binding site.

The term "bispecific antibody," as used herein, refers to full-length antibodies that are generated by quadroma technology (see Milstein, C. and Cuello, A. C. (1983) Nature 305(5934): p. 537-540), by chemical conjugation of two different monoclonal antibodies (see Staerz, U. D. et al. (1985) Nature 314(6012): 628-631), or by knob-into-hole or similar approaches, which introduce mutations in the Fc region (see Holliger, P. et al. (1993) Proc. Natl. Acad. Sci. USA 90(14): 6444-6448), resulting in multiple different immunoglobulin species of which only one is the functional bispecific antibody. By molecular function, a bispecific antibody binds one antigen (or epitope) on one of its two binding arms (one pair of HC/LC), and binds a different antigen (or epitope) on its second arm (a different pair of HC/LC). By this definition, a bispecific antibody has two distinct antigen binding arms (in both specificity and CDR sequences), and is monovalent for each antigen it binds to.

The term "dual-specific antibody," as used herein, refers to full-length antibodies that can bind two different antigens (or epitopes) in each of its two binding arms (a pair of HC/LC) (see PCT Publication No. WO 02/02773). Accordingly a dual-specific binding protein has two identical antigen binding arms, with identical specificity and identical CDR sequences, and is bivalent for each antigen to which it binds.

A "functional antigen binding site" of a binding protein is one that binds a target antigen. The antigen binding affinity of the antigen binding site is not necessarily as strong as the parent antibody from which the antigen binding site is derived, but the ability to bind antigen must be measurable using any one of a variety of methods known for evaluating antibody binding to an antigen. Moreover, the antigen binding affinity of each of the antigen binding sites of a multivalent antibody herein need not be quantitatively the same.

The term "cytokine" is a generic term for proteins released by one cell population, which act on another cell population as intercellular mediators. Examples of such cytokines are lymphokines, monokines, and traditional polypeptide hormones. Included among the cytokines are growth hormone such as human growth hormone, N-methionyl human growth hormone, and bovine growth hormone; parathyroid hormone; thyroxine; insulin; proinsulin; relaxin; prorelaxin; glycoprotein hormones such as follicle stimulating hormone (FSH), thyroid stimulating hormone (TSH), and luteinizing hormone (LH); hepatic growth factor; fibroblast growth factor; prolactin; placental lactogen; tumor necrosis factor-alpha and -beta; mullerian-inhibiting substance; mouse gonadotropin-associated peptide; inhibin; activin; vascular endothelial growth factor; integrin; thrombopoietin (TPO); nerve growth factors such as NGF-alpha; platelet-growth factor; placental growth factor, transforming growth factors (TGFs) such as TGF-alpha and TGF-beta; insulin-like growth factor-1 and -11; erythropoietin (EPO); osteoinductive factors; interferons such as interferon-alpha, -beta and -gamma colony stimulating factors (CSFs) such as macrophage-CSF (M-CSF); granulocyte macrophage-CSF (GM-CSF); and granulocyte-CSF (G-CSF); interleukins (ILs) such as IL-1, IL-2, IL-3, IL-4, IL-5, IL-6, IL-7, IL-8, IL-9, IL-10, IL-11, IL-12, IL-13, IL-15, IL-18, IL-21, IL-22, IL-23, and IL-33; a tumor necrosis factor such as TNF-alpha or TNF-beta; and other polypeptide factors including LIF and kit ligand (KL). As used herein, the term cytokine includes proteins from natural sources or from recombinant cell culture and biologically active equivalents of the native sequence cytokines.

The term "linker" is used to denote polypeptides comprising two or more amino acid residues joined by peptide bonds and are used to link one or more antigen binding portions. Such linker polypeptides are well known in the art (see e.g., Holliger, P., et al. (1993) Proc. Natl. Acad. Sci. USA 90:6444-6448; Poljak, R. J., et al. (1994) Structure 2:1121-1123). Exemplary linkers include, but are not limited to, AKTTPKLEEGEFSEAR (SEQ ID NO: 1); AKTTPKLEEGEFSEARV (SEQ ID NO: 2); AKTTPKLGG (SEQ ID NO: 3); SAKTTPKLGG (SEQ ID NO: 4); SAKTTP (SEQ ID NO: 5); RADAAP (SEQ ID NO: 6); RADAAPTVS (SEQ ID NO: 7); RADAAAAGGPGS (SEQ ID NO: 8); RADAAAA($G_4S$)$_4$ (SEQ ID NO: 9); SAKTTPKLEEGEFSEARV (SEQ ID NO: 10); ADAAP (SEQ ID NO: 11); ADAAPTVSIFPP (SEQ ID NO: 12); TVAAP (SEQ ID NO: 13); TVAAPSVFIFPP (SEQ ID NO: 14); QPKAAP (SEQ ID NO: 15); QPKAAPSVTLFPP (SEQ ID NO: 16); AKTTPP (SEQ ID NO: 17); AKTTPPSVTPLAP (SEQ ID NO: 18); AKTTAP (SEQ ID NO: 19); AKTTAPSVYPLAP (SEQ ID NO: 20); ASTKGP (SEQ ID NO: 21); ASTKGPSVFPLAP (SEQ ID NO: 22), GGGGSGGGGSGGGGS (SEQ ID NO: 23); GENKVEYAPALMALS (SEQ ID NO: 24); GPAKELTPLKEAKVS (SEQ ID NO: 25); GHEAAAVMQVQYPAS (SEQ ID NO: 26), TVAAPSVFIFPPTVAAPSVFIFPP (SEQ ID NO: 27); and ASTKGPSVFPLAPASTKGPSVFPLAP (SEQ ID NO: 28.

An "immunoglobulin constant domain" refers to a heavy or light chain constant domain. Human IgG heavy chain and light chain constant domain amino acid sequences are known in the art.

The term "monoclonal antibody" or "mAb" as used herein refers to an antibody obtained from a population of substantially homogeneous antibodies, i.e., the individual antibodies comprising the population are identical except for possible naturally occurring mutations that may be present in minor amounts. Monoclonal antibodies are highly specific, being directed against a single antigen. Furthermore, in contrast to polyclonal antibody preparations that typically include different antibodies directed against different determinants (epitopes), each mAb is directed against a single determinant on the antigen. The modifier "monoclonal" is not to be construed as requiring production of the antibody by any particular method.

The term "human antibody," as used herein, is intended to include antibodies having variable and constant regions derived from human germline immunoglobulin sequences. The human antibodies provided herein may include amino acid residues not encoded by human germline immunoglobulin sequences (e.g., mutations introduced by random or site-specific mutagenesis in vitro or by somatic mutation in vivo), for example in the CDRs and in particular CDR3. However, the term "human antibody," as used herein, is not intended to include antibodies in which CDR sequences derived from the germline of another mammalian species, such as a mouse, have been grafted onto human framework sequences.

The term "recombinant human antibody," as used herein, is intended to include all human antibodies that are prepared, expressed, created or isolated by recombinant means, such as antibodies expressed using a recombinant expression vector transfected into a host cell (described further in Section II C, below), antibodies isolated from a recombinant, combinatorial human antibody library (Hoogenboom H. R. (1997) TIB Tech. 15:62-70; Azzazy H., and Highsmith W. E. (2002) Clin. Biochem. 35:425-445; Gavilondo J. V., and Larrick J. W. (2002) BioTechniques 29:128-145; Hoogenboom H., and Chames P. (2000) Immunol. Today 21: 371-378), antibodies isolated from an animal (e.g., a mouse) that is transgenic for human immunoglobulin genes (see, Taylor, L. D., et al. (1992) Nucl. Acids Res. 20: 6287-6295; Kellermann S-A. and Green L. L. (2002) Current Opinion in Biotechnol. 13: 593-597; Little M. et al. (2000) Immunol. Today 21:364-370) or antibodies prepared, expressed, created or isolated by any other means that involves splicing of human immunoglobulin gene sequences to other DNA sequences. Such recombinant human antibodies have variable and constant regions derived from human germline immunoglobulin sequences. In certain embodiments, however, such recombinant human antibodies are subjected to in vitro mutagenesis (or, when an animal transgenic for human Ig sequences is used, in vivo somatic mutagenesis) and thus the amino acid sequences of the VH and VL regions of the recombinant antibodies are sequences that, while derived from and related to human germline VH and VL sequences, may not naturally exist within the human antibody germline repertoire in vivo.

An "affinity matured" antibody is an antibody with one or more alterations in one or more CDRs thereof which result an improvement in the affinity of the antibody for antigen, compared to a parent antibody which does not possess those alteration(s). Exemplary affinity matured antibodies will have nanomolar or even picomolar affinities for the target antigen. Affinity matured antibodies are produced by procedures known in the art. Marks et al. (1992) Bio/Technology 10: 779-783 describes affinity maturation by VH and VL domain shuffling. Random mutagenesis of CDR and/or framework residues is described by Barbas, et al. (1994) Proc Nat. Acad. Sci. USA 91: 3809-3813; Schier et al. (1995) Gene 169: 147-155; Yelton et al., (1995) J. Immunol. 155: 1994-2004; Jackson et al. (1995) J. Immunol. 154(7): 3310-9; and Hawkins et al. (1992) J. Mol. Biol. 226: 889-896; and selective mutation at selective mutagenesis positions, contact or hypermutation positions with an activity enhancing amino acid residue is described in U.S. Pat. No. 6,914,128.

The term "chimeric antibody" refers to antibodies which comprise heavy and light chain variable region sequences from one species and constant region sequences from another species, such as antibodies having murine heavy and light chain variable regions linked to human constant regions.

The term "CDR-grafted antibody" refers to antibodies which comprise heavy and light chain variable region sequences from one species but in which the sequences of one or more of the CDR regions of VH and/or VL are replaced with CDR sequences of another species, such as antibodies having murine heavy and light chain variable regions in which one or more of the murine CDRs (e.g., CDR3) has been replaced with human CDR sequences.

The term "humanized antibody" refers to antibodies which comprise heavy and light chain variable region sequences from a non-human species (e.g., a mouse) but in which at least a portion of the VH and/or VL sequence has been altered to be more "human-like," i.e., more similar to human germline variable sequences. One type of humanized antibody is a CDR-grafted antibody, in which non-human CDR sequences are introduced into human VH and VL sequences to replace the corresponding human CDR sequences. Also "humanized antibody" is an antibody or a variant, derivative, analog or fragment thereof which immunospecifically binds to an antigen of interest and which comprises a framework (FR) region having substantially the amino acid sequence of a human antibody and a complementary determining region (CDR) having substantially the amino acid sequence of a non-human antibody. As used herein, the term "substantially" in the context of a CDR refers to a CDR having an amino acid sequence at least 80%, at least 85%, at least 90%, at least 95%, at least 98% or at least 99% identical to the amino acid sequence of a non-human antibody CDR. A humanized antibody comprises substantially all of at least one, and typically two, variable domains (Fab, Fab', F(ab')2, FabC, Fv) in which all or substantially all of the CDR regions correspond to those of a non-human immunoglobulin (i.e., donor antibody) and all or substantially all of the framework regions are those of a human immunoglobulin consensus sequence. In an embodiment, a humanized antibody also comprises at least a portion of an immunoglobulin constant region (Fc), typically that of a human immunoglobulin. In some embodiments, a humanized antibody contains both the light chain as well as at least the variable domain of a heavy chain. The antibody also may include the CH1, hinge, CH2, CH3, and CH4 regions of the heavy chain. In some embodiments, a humanized antibody only contains a humanized light chain. In some embodiments, a humanized antibody only contains a humanized heavy chain. In specific embodiments, a humanized antibody only contains a humanized variable domain of a light chain and/or humanized heavy chain.

The terms "Kabat numbering," "Kabat definitions" and "Kabat labeling" are used interchangeably herein. These terms, which are recognized in the art, refer to a system of numbering amino acid residues which are more variable (i.e., hypervariable) than other amino acid residues in the heavy and light chain variable regions of an antibody, or an antigen binding portion thereof (Kabat et al. (1971) Ann. NY Acad, Sci. 190:382-391 and, Kabat, E. A., et al. (1991) Sequences of Proteins of Immunological Interest, Fifth Edition, U.S. Department of Health and Human Services, NIH Publication No. 91-3242). For the heavy chain variable region, the hypervariable region ranges from amino acid positions 31 to 35 for CDR1, amino acid positions 50 to 65 for CDR2, and amino acid positions 95 to 102 for CDR3. For the light chain variable region, the hypervariable region ranges from amino acid positions 24 to 34 for CDR1, amino acid positions 50 to 56 for CDR2, and amino acid positions 89 to 97 for CDR3.

As used herein, the term "CDR" refers to the complementarity determining region within antibody variable sequences. There are three CDRs in each of the variable regions of the heavy chain and the light chain, which are designated CDR1, CDR2 and CDR3, for each of the variable regions. The term "CDR set" as used herein refers to a group of three CDRs that occur in a single variable region that binds the antigen. The exact boundaries of these CDRs have been defined differently according to different systems. The system described by Kabat (Kabat et al., Sequences of Proteins of Immunological Interest (National Institutes of Health, Bethesda, Md. (1987) and (1991)) not only provides an unambiguous residue numbering system applicable to any variable region of an antibody, but also provides precise residue boundaries defining the three CDRs. These CDRs may be referred to as Kabat CDRs. Chothia and coworkers (Chothia &Lesk (1987) J. Mol. Biol. 196:901-917 and Chothia et al. (1989) Nature 342:877-883) found that certain sub-portions within Kabat CDRs adopt nearly identical peptide backbone conformations, despite having great diversity at the level of amino acid sequence. These sub-portions were designated as L1, L2 and L3 or H1, H2 and H3 where the "L" and the "H" designate the light chain and the heavy chain regions, respectively. These regions may be referred to as Chothia CDRs, which have boundaries that overlap with Kabat CDRs. Other boundaries defining CDRs overlapping with the Kabat CDRs have been described by Padlan (1995) FASEB J. 9: 133-139 and MacCallum (1996) J. Mol. Biol. 262(5): 732-45. Still other CDR boundary definitions may not strictly follow one of the herein systems, but will nonetheless overlap with the Kabat CDRs, although they may be shortened or lengthened in light of prediction or experimental findings that particular residues or groups of residues or even entire CDRs do not significantly impact antigen binding. The methods used herein may utilize CDRs defined according to any of these systems, although certain embodiments use Kabat or Chothia defined CDRs.

As used herein, the term "framework" or "framework sequence" refers to the remaining sequences of a variable region minus the CDRs. Because the exact definition of a CDR sequence can be determined by different systems, the meaning of a framework sequence is subject to correspondingly different interpretations. The six CDRs (CDR-L1, -L2, and -L3 of light chain and CDR-H1, -H2, and -H3 of heavy chain) also divide the framework regions on the light chain and the heavy chain into four sub-regions (FR1, FR2, FR3 and FR4) on each chain, in which CDR1 is positioned between FR1 and FR2, CDR2 between FR2 and FR3, and CDR3 between FR3 and FR4. Without specifying the particular sub-regions as FR1, FR2, FR3 or FR4, a framework region, as referred by others, represents the combined FR's within the variable region of a single, naturally occurring immunoglobulin chain. As used herein, a FR represents one of the four sub-regions, and FRs represents two or more of the four sub-regions constituting a framework region.

As used herein, the term "germline antibody gene" or "gene fragment" refers to an immunoglobulin sequence encoded by non-lymphoid cells that have not undergone the maturation process that leads to genetic rearrangement and mutation for expression of a particular immunoglobulin. (See, e.g., Shapiro et al. (2002) Crit. Rev. Immunol. 22(3): 183-200; Marchalonis et al. (2001) Adv. Exp. Med. Biol. 484: 13-30). One of the advantages provided by various embodiments provided herein stems from the recognition that germline antibody genes are more likely than mature antibody genes to conserve essential amino acid sequence structures characteristic of individuals in the species, hence less likely to be recognized as from a foreign source when used therapeutically in that species.

As used herein, the term "neutralizing" refers to counteracting the biological activity of an antigen when a binding protein specifically binds the antigen. In an embodiment, the neutralizing binding protein binds the cytokine and reduces its biologically activity by at least about 20%, 40%, 60%, 80%, 85% or more.

The term "activity" includes activities such as the binding specificity and affinity of a DVD-Ig for two or more antigens.

The term "epitope" includes any polypeptide determinant that specifically binds to an immunoglobulin or T-cell receptor. In certain embodiments, epitope determinants include chemically active surface groupings of molecules such as amino acids, sugar side chains, phosphoryl, or sulfonyl, and, in certain embodiments, may have specific three dimensional structural characteristics, and/or specific charge characteristics. An epitope is a region of an antigen that is bound by an antibody. An epitope thus consists of the amino acid residues of a region of an antigen (or fragment thereof) known to bind to the complementary site on the specific binding partner. An antigenic fragment can contain more than one epitope. In certain embodiments, an antibody is said to specifically bind an antigen when it recognizes its target antigen in a complex mixture of proteins and/or macromolecules. Antibodies are said to "bind to the same epitope" if the antibodies cross-compete (one prevents the binding or modulating effect of the other). In addition structural definitions of epitopes (overlapping, similar, identical) are informative, but functional definitions are often more relevant as they encompass structural (binding) and functional (modulation, competition) parameters.

The term "surface plasmon resonance," as used herein, refers to an optical phenomenon that allows for the analysis of real-time biospecific interactions by detection of alterations in protein concentrations within a biosensor matrix, for example using the BIAcore® system (BIAcore International AB, a GE Healthcare company, Uppsala, Sweden and Piscataway, N.J.). For further descriptions, see Jönsson, U., et al. (1993) Ann. Biol. Clin. 51:19-26; Jönsson, U., et al. (1991) Biotechniques 11:620-627; Johnsson, B., et al. (1995) J. Mol. Recognit. 8:125-131; and Johnnson, B., et al. (1991) Anal. Biochem. 198:268-277.

The term "$K_{on}$," as used herein, is intended to refer to the on rate constant for association of a binding protein (e.g., an antibody) to the antigen to form the, e.g., antibody/antigen complex as is known in the art. The "$K_{on}$," also is known by the terms "association rate constant," or "$k_a$," as used interchangeably herein. This value indicating the binding rate of an antibody to its target antigen or the rate of complex formation between an antibody and antigen also is shown by the equation:

Antibody("Ab")+Antigen("Ag")→Ab–Ag.

The term "$K_{off}$," as used herein, is intended to refer to the off rate constant for dissociation of a binding protein (e.g., an antibody) from the, e.g., antibody/antigen complex as is known in the art. The "Koff" also is known by the terms "dissociation rate constant" or "kd" as used interchangeably herein. This value indicates the dissociation rate of an antibody from its target antigen or separation of Ab–Ag complex over time into free antibody and antigen as shown by the equation below:

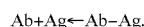
Ab+Ag←Ab–Ag.

The terms "equilibrium dissociation constant" or "$K_D$," as used interchangeably herein, refer to the value obtained in a titration measurement at equilibrium, or by dividing the dissociation rate constant ($k_{off}$) by the association rate constant ($k_{on}$). The association rate constant, the dissociation rate constant and the equilibrium dissociation constant are used to represent the binding affinity of an antibody to an antigen. Methods for determining association and dissociation rate constants are well known in the art. Using fluorescence-based techniques offers high sensitivity and the ability to examine samples in physiological buffers at equilibrium. Other experimental approaches and instruments such as a BIAcore® (biomolecular interaction analysis) assay can be used (e.g., instrument available from BIAcore International AB, a GE Healthcare company, Uppsala, Sweden). Additionally, a KinExA® (Kinetic Exclusion Assay) assay, available from Sapidyne Instruments (Boise, Id.) can also be used.

"Label" and "detectable label" mean a moiety attached to a specific binding partner, such as an antibody or an analyte, e.g., to render the reaction between members of a specific binding pair, such as an antibody and an analyte, detectable, and the specific binding partner, e.g., antibody or analyte, so labeled is referred to as "detectably labeled." Thus, the term "labeled binding protein" as used herein, refers to a protein with a label incorporated that provides for the identification of the binding protein. In an embodiment, the label is a detectable marker that can produce a signal that is detectable by visual or instrumental means, e.g., incorporation of a radiolabeled amino acid or attachment to a polypeptide of biotinyl moieties that can be detected by marked avidin (e.g., streptavidin containing a fluorescent marker or enzymatic activity that can be detected by optical or colorimetric methods). Examples of labels for polypeptides include, but are not limited to, the following: radioisotopes or radionuclides (e.g., $^{3}$H, $^{14}$C, $^{35}$S, $^{90}$Y, $^{99}$Tc, $^{111}$In, $^{125}$I, $^{131}$I, $^{177}$Lu, $^{166}$Ho, and $^{153}$Sm); chromogens, fluorescent labels (e.g., FITC, rhodamine, and lanthanide phosphors), enzymatic labels (e.g., horseradish peroxidase, luciferase, alkaline phosphatase); chemiluminescent markers; biotinyl groups; predetermined polypeptide epitopes recognized by a secondary reporter (e.g., leucine zipper pair sequences, binding sites for secondary antibodies, metal binding domains, and epitope tags); and magnetic agents, such as gadolinium chelates. Representative examples of labels commonly employed for immunoassays include moieties that produce light, e.g., acridinium compounds, and moieties that produce fluorescence, e.g., fluorescein. Other labels are described herein. In this regard, the moiety itself may not be detectably labeled but may become detectable upon reaction with yet another moiety. Use of "detectably labeled" is intended to encompass the latter type of detectable labeling.

The term "conjugate" refers to a binding protein, such as an antibody, chemically linked to a second chemical moiety, such as a therapeutic or cytotoxic agent. The term "agent" is used herein to denote a chemical compound, a mixture of chemical compounds, a biological macromolecule, or an extract made from biological materials. In an embodiment, the therapeutic or cytotoxic agents include, but are not limited to, pertussis toxin, taxol, cytochalasin B, gramicidin D, ethidium bromide, emetine, mitomycin, etoposide, tenoposide, vincristine, vinblastine, colchicin, doxorubicin, daunorubicin, dihydroxy anthracin dione, mitoxantrone, mithramycin, actinomycin D, 1-dehydrotestosterone, glucocorticoids, procaine, tetracaine, lidocaine, propranolol, and puromycin and analogs or homologs thereof. When employed in the context of an immunoassay, the conjugate antibody is a detectably labeled antibody used as the detection antibody.

The terms "crystal" and "crystallized" as used herein, refer to a binding protein (e.g., an antibody), or antigen binding portion thereof, that exists in the form of a crystal. Crystals are one form of the solid state of matter, which is distinct from other forms such as the amorphous solid state or the liquid crystalline state. Crystals are composed of regular, repeating, three-dimensional arrays of atoms, ions, molecules (e.g., proteins such as antibodies), or molecular assemblies (e.g., antigen/antibody complexes). These three-dimensional arrays are arranged according to specific mathematical relationships that are well-understood in the field. The fundamental unit, or building block, that is repeated in a crystal is called the asymmetric unit. Repetition of the asymmetric unit in an arrangement that conforms to a given, well-defined crystallographic symmetry provides the "unit cell" of the crystal. Repetition of the unit cell by regular translations in all three dimensions provides the crystal. See Giege, R. and Ducruix, A. Barrett, Crystallization of Nucleic Acids and Proteins, a Practical Approach, 2nd ea., pp. 20 1-16, Oxford University Press, New York, N.Y., (1999)."

The term "polynucleotide" means a polymeric form of two or more nucleotides, either ribonucleotides or deoxynucleotides or a modified form of either type of nucleotide. The term includes single and double stranded forms of DNA.

The term "isolated polynucleotide" shall mean a polynucleotide (e.g., of genomic, cDNA, or synthetic origin, or some combination thereof) that, by virtue of its origin, the "isolated polynucleotide" is not associated with all or a portion of a polynucleotide with which the "isolated polynucleotide" is found in nature; is operably linked to a polynucleotide that it is not linked to in nature; or does not occur in nature as part of a larger sequence.

The term "vector," is intended to refer to a nucleic acid molecule capable of transporting another nucleic acid to which it has been linked. One type of vector is a "plasmid," which refers to a circular double stranded DNA loop into which additional DNA segments may be ligated. Another type of vector is a viral vector, wherein additional DNA segments may be ligated into the viral genome. Certain vectors are capable of autonomous replication in a host cell into which they are introduced (e.g., bacterial vectors having a bacterial origin of replication and episomal mammalian vectors). Other vectors (e.g., non-episomal mammalian vectors) can be integrated into the genome of a host cell upon introduction into the host cell, and thereby are replicated along with the host genome. Moreover, certain vectors are capable of directing the expression of genes to which they are operatively linked. Such vectors are referred to herein as "recombinant expression vectors" (or simply, "expression vectors"). In general, expression vectors of utility in recombinant DNA techniques are often in the form of plasmids. In the present specification, "plasmid" and "vector" may be used interchangeably as the plasmid is the most commonly used form of vector. However, additional embodiments include such other forms of expression vectors, such as viral vectors (e.g., replication defective retroviruses, adenoviruses and adeno-associated viruses), which serve equivalent functions.

The term "operably linked" refers to a juxtaposition wherein the components described are in a relationship permitting them to function in their intended manner. A control sequence "operably linked" to a coding sequence is ligated in such a way that expression of the coding sequence is achieved under conditions compatible with the control sequences. "Operably linked" sequences include both expression control sequences that are contiguous with the gene of interest and expression control sequences that act in trans or at a distance to control the gene of interest. The term "expression control sequence" as used herein refers to polynucleotide sequences which are necessary to effect the expression and processing of coding sequences to which they are ligated. Expression control sequences include appropriate transcription initiation, termination, promoter and enhancer sequences; efficient RNA processing signals such as splicing and polyadenylation signals; sequences that stabilize cytoplasmic mRNA; sequences that enhance translation efficiency (i.e., Kozak consensus sequence); sequences that enhance protein stability; and when desired, sequences that enhance protein secretion. The nature of such control sequences differs depending upon the host organism; in prokaryotes, such control sequences generally include a promoter, a ribosomal binding site, and a transcription termination sequence; in eukaryotes, generally, such control sequences include a promoter and a transcription termination sequence. The term "control sequences" is intended to include components whose presence is essential for expression and processing, and can also include additional components whose presence is advantageous, for example, leader sequences and fusion partner sequences.

"Transformation," refers to any process by which exogenous DNA enters a host cell. Transformation may occur under natural or artificial conditions using various methods well known in the art. Transformation may rely on any known method for the insertion of foreign nucleic acid sequences into a prokaryotic or eukaryotic host cell. The method is selected based on the host cell being transformed and may include, but is not limited to, viral infection, electroporation, lipofection, and particle bombardment. Such "transformed" cells include stably transformed cells in which the inserted DNA is capable of replication either as an autonomously replicating plasmid or as part of the host chromosome. They also include cells which transiently express the inserted DNA or RNA for limited periods of time.

The term "recombinant host cell" (or simply "host cell"), is intended to refer to a cell into which exogenous DNA has been introduced. In an embodiment, the host cell comprises two or more (e.g., multiple) nucleic acids encoding antibodies, such as the host cells described in U.S. Pat. No. 7,262,028, for example. Such terms are intended to refer not only to the particular subject cell, but, also to the progeny of such a cell. Because certain modifications may occur in succeeding generations due to either mutation or environmental influences, such progeny may not, in fact, be identical to the parent cell, but are still included within the scope of the term "host cell" as used herein. In an embodiment, host cells include prokaryotic and eukaryotic cells selected from any of the Kingdoms of life. In another embodiment, eukaryotic cells include protist, fungal, plant and animal cells. In another embodiment, host cells include but are not limited to the prokaryotic cell line *E. coli*; mammalian cell lines CHO, HEK 293, COS, NS0, SP2 and PER.C6; the insect cell line Sf9; and the fungal cell *Saccharomyces cerevisiae*.

Standard techniques may be used for recombinant DNA, oligonucleotide synthesis, and tissue culture and transformation (e.g., electroporation, lipofection). Enzymatic reactions and purification techniques may be performed according to manufacturers specifications or as commonly accomplished in the art or as described herein. The foregoing techniques and procedures may be generally performed according to conventional methods well known in the art and as described in various general and more specific references that are cited and discussed throughout the present specification. See e.g., Sambrook et al. (1989) Molecular Cloning: A Laboratory Manual (2d ed., Cold Spring Harbor Laboratory Press, Cold Spring Harbor, N.Y.).

"Transgenic organism," as known in the art, refers to an organism having cells that contain a transgene, wherein the transgene introduced into the organism (or an ancestor of the organism) expresses a polypeptide not naturally expressed in the organism. A "transgene" is a DNA construct, which is stably and operably integrated into the genome of a cell from which a transgenic organism develops, directing the expression of an encoded gene product in one or more cell types or tissues of the transgenic organism.

The term "regulate" and "modulate" are used interchangeably, and, as used herein, refers to a change or an alteration in the activity of a molecule of interest (e.g., the biological activity of a cytokine). Modulation may be an increase or a decrease in the magnitude of a certain activity or function of the molecule of interest. Exemplary activities and functions of a molecule include, but are not limited to, binding characteristics, enzymatic activity, cell receptor activation, and signal transduction.

Correspondingly, the term "modulator" is a compound capable of changing or altering an activity or function of a molecule of interest (e.g., the biological activity of a cytokine). For example, a modulator may cause an increase or decrease in the magnitude of a certain activity or function of a molecule compared to the magnitude of the activity or function observed in the absence of the modulator. In certain embodiments, a modulator is an inhibitor, which decreases the magnitude of at least one activity or function of a molecule. Exemplary inhibitors include, but are not limited to, proteins, peptides, antibodies, peptibodies, carbohydrates or small organic molecules. Peptibodies are described, e.g., in WO01/83525.

The term "agonist," refers to a modulator that, when contacted with a molecule of interest, causes an increase in the magnitude of a certain activity or function of the molecule compared to the magnitude of the activity or function observed in the absence of the agonist. Particular agonists of interest may include, but are not limited to, polypeptides, nucleic acids, carbohydrates, and any other molecules that bind to the antigen.

The term "antagonist" or "inhibitor," refers to a modulator that, when contacted with a molecule of interest, causes a decrease in the magnitude of a certain activity or function of the molecule compared to the magnitude of the activity or function observed in the absence of the antagonist. Particular antagonists of interest include those that block or modulate the biological or immunological activity of the antigen. Antagonists and inhibitors of antigens may include, but are not limited to, proteins, nucleic acids, carbohydrates, and any other molecules, which bind to the antigen.

As used herein, the term "effective amount" refers to the amount of a therapy which is sufficient to reduce or ameliorate the severity and/or duration of a disorder or one or more symptoms thereof, inhibit or prevent the advancement of a disorder, cause regression of a disorder, inhibit or prevent the recurrence, development, onset or progression of one or more symptoms associated with a disorder, detect a disorder, or enhance or improve the prophylactic or therapeutic effect(s) of another therapy (e.g., prophylactic or therapeutic agent).

"Patient" and "subject" may be used interchangeably herein to refer to an animal, such as a mammal, including a primate (for example, a human, a monkey, and a chimpanzee), a non-primate (for example, a cow, a pig, a camel, a llama, a horse, a goat, a rabbit, a sheep, a hamster, a guinea pig, a cat, a dog, a rat, a mouse, and a whale), a bird (e.g., a duck or a goose), and a shark. Preferably, the patient or subject is a human, such as a human being treated or assessed for a disease, disorder or condition, a human at risk for a disease, disorder or condition, a human having a disease, disorder or condition, and/or human being treated for a disease, disorder or condition.

The term "sample," as used herein, is used in its broadest sense. A "biological sample," as used herein, includes, but is not limited to, any quantity of a substance from a living thing or formerly living thing. Such living things include, but are not limited to, humans, mice, rats, monkeys, dogs, rabbits and other animals. Such substances include, but are not limited to, blood, (e.g., whole blood), plasma, serum, urine, amniotic fluid, synovial fluid, endothelial cells, leukocytes, monocytes, other cells, organs, tissues, bone marrow, lymph nodes and spleen.

"Component," "components," and "at least one component," refer generally to a capture antibody, a detection or conjugate antibody, a control, a calibrator, a series of calibrators, a sensitivity panel, a container, a buffer, a diluent, a salt, an enzyme, a co-factor for an enzyme, a detection reagent, a pretreatment reagent/solution, a substrate (e.g., as a solution), a stop solution, and the like that can be included in a kit for assay of a test sample, such as a patient urine, serum or plasma sample, in accordance with the methods described herein and other methods known in the art. Thus, in the context of the present disclosure, "at least one component," "component," and "components" can include a polypeptide or other analyte as above, such as a composition comprising an analyte such as polypeptide, which is optionally immobilized on a solid support, such as by binding to an anti-analyte (e.g., anti-polypeptide) antibody. Some components can be in solution or lyophilized for reconstitution for use in an assay.

"Control" refers to a composition known to not contain analyte ("negative control") or to contain analyte ("positive control"). A positive control can comprise a known concentration of analyte. "Control," "positive control," and "calibrator" may be used interchangeably herein to refer to a composition comprising a known concentration of analyte. A "positive control" can be used to establish assay performance characteristics and is a useful indicator of the integrity of reagents (e.g., analytes).

"Predetermined cutoff" and "predetermined level" refer generally to an assay cutoff value that is used to assess diagnostic/prognostic/therapeutic efficacy results by comparing the assay results against the predetermined cutoff/level, where the predetermined cutoff/level already has been linked or associated with various clinical parameters (e.g., severity of disease, progression/nonprogression/improvement, etc.). While the present disclosure may provide exemplary predetermined levels, it is well-known that cutoff values may vary depending on the nature of the immunoassay (e.g., antibodies employed, etc.). It further is well within the ordinary skill of one in the art to adapt the disclosure herein for other immunoassays to obtain immunoassay-specific cutoff values for those other immunoassays based on this disclosure. Whereas the precise value of the predetermined cutoff/level may vary between assays, correlations as described herein (if any) should be generally applicable.

"Pretreatment reagent," e.g., lysis, precipitation and/or solubilization reagent, as used in a diagnostic assay as described herein is one that lyses any cells and/or solubilizes any analyte that is/are present in a test sample. Pretreatment is not necessary for all samples, as described further herein. Among other things, solubilizing the analyte (e.g., polypeptide of interest) may entail release of the analyte from any endogenous binding proteins present in the sample. A pretreatment reagent may be homogeneous (not requiring a separation step) or heterogeneous (requiring a separation step). With use of a heterogeneous pretreatment reagent there is removal of any precipitated analyte binding proteins from the test sample prior to proceeding to the next step of the assay.

"Quality control reagents" in the context of immunoassays and kits described herein, include, but are not limited to, calibrators, controls, and sensitivity panels. A "calibrator" or "standard" typically is used (e.g., one or more, such as a plurality) in order to establish calibration (standard) curves for interpolation of the concentration of an analyte, such as an antibody or an analyte. Alternatively, a single calibrator, which is near a predetermined positive/negative cutoff, can be used. Multiple calibrators (i.e., more than one calibrator or a varying amount of calibrator(s)) can be used in conjunction so as to comprise a "sensitivity panel."

"Risk" refers to the possibility or probability of a particular event occurring either presently or at some point in the future. "Risk stratification" refers to an array of known clinical risk factors that allows physicians to classify patients into a low, moderate, high or highest risk of developing a particular disease, disorder or condition.

"Specific" and "specificity" in the context of an interaction between members of a specific binding pair (e.g., an antigen (or fragment thereof) and an antibody (or antigenically reactive fragment thereof)) refer to the selective reactivity of the interaction. The phrase "specifically binds to" and analogous phrases refer to the ability of antibodies (or antigenically reactive fragments thereof) to bind specifically to analyte (or a fragment thereof) and not bind specifically to other entities.

"Specific binding partner" is a member of a specific binding pair. A specific binding pair comprises two different molecules, which specifically bind to each other through chemical or physical means. Therefore, in addition to antigen and antibody specific binding pairs of common immunoassays, other specific binding pairs can include biotin and avidin (or streptavidin), carbohydrates and lectins, complementary nucleotide sequences, effector and receptor molecules, cofactors and enzymes, enzyme inhibitors and enzymes, and the like. Furthermore, specific binding pairs can include members that are analogs of the original specific binding members, for example, an analyte-analog. Immunoreactive specific binding members include antigens, antigen fragments, and antibodies, including monoclonal and polyclonal antibodies as well as complexes, fragments, and variants (including fragments of variants) thereof, whether isolated or recombinantly produced.

"Variant" as used herein means a polypeptide that differs from a given polypeptide (e.g., IL-18, BNP, NGAL or HIV polypeptide or anti-polypeptide antibody) in amino acid sequence by the addition (e.g., insertion), deletion, or conservative substitution of amino acids, but that retains the biological activity of the given polypeptide (e.g., a variant IL-1β can compete with anti-IL-1β antibody for binding to IL-18). A conservative substitution of an amino acid, i.e., replacing an amino acid with a different amino acid of similar properties (e.g., hydrophilicity and degree and distribution of charged regions) is recognized in the art as typically involving a minor change. These minor changes can be identified, in part, by considering the hydropathic index of amino acids, as understood in the art (see, e.g., Kyte et al. (1982) J. Mol. Biol. 157: 105-132). The hydropathic index of an amino acid is based on a consideration of its hydrophobicity and charge. It is known in the art that amino acids of similar hydropathic indexes can be substituted and still retain protein function. In one aspect, amino acids having hydropathic indexes of ±2 are substituted. The hydrophilicity of amino acids also can be used to reveal substitutions that would result in proteins retaining biological function. A consideration of the hydrophilicity of amino acids in the context of a peptide permits calculation of the greatest local average hydrophilicity of that peptide, a useful measure that has been reported to correlate well with antigenicity and immunogenicity (see, e.g., U.S. Pat. No. 4,554,101. Substitution of amino acids having similar hydrophilicity values can result in peptides retaining biological activity, for example immunogenicity, as is understood in the art. In one aspect, substitutions are performed with amino acids having hydrophilicity values within ±2 of each other. Both the hydrophobicity index and the hydrophilicity value of amino acids are influenced by the particular side chain of that amino acid. Consistent with that observation, amino acid substitutions that are compatible with biological function are understood to depend on the relative similarity of the amino acids, and particularly the side chains of those amino acids, as revealed by the hydrophobicity, hydrophilicity, charge, size, and other properties. "Variant" also can be used to describe a polypeptide or fragment thereof that has been differentially processed, such as by proteolysis, phosphorylation, or other post-translational modification, yet retains its biological activity or antigen reactivity, e.g., the ability to bind to IL-18. Use of "variant" herein is intended to encompass fragments of a variant unless otherwise contradicted by context.

I. Generation of DVD Binding Protein

Dual Variable Domain binding proteins that bind one or more targets and methods of making the same are provided. In an embodiment, the binding protein comprises a polypeptide chain, wherein said polypeptide chain comprises VD1-(X1)n-VD2-C—(X2)n, wherein VD1 is a first variable domain, VD2 is a second variable domain, C is a constant domain, X1 represents an amino acid or polypeptide, X2 represents an Fc region and n is 0 or 1. The binding protein can be generated using various techniques. Expression vectors, host cells, and methods of generating the binding protein are provided.

A. Generation of Parent Monoclonal Antibodies

The variable domains of the DVD binding protein can be obtained from parent antibodies, including polyclonal and mAbs that bind antigens of interest. These antibodies may be naturally occurring or may be generated by recombinant technology.

MAbs can be prepared using a wide variety of techniques known in the art including the use of hybridoma, recombinant, and phage display technologies, or a combination thereof. For example, mAbs can be produced using hybridoma techniques including those known in the art and taught, for example, in Harlow et al. (1988) Antibodies: A Laboratory Manual, (Cold Spring Harbor Laboratory Press, 2nd ed.); Hammerling, et al. (1981) in: Monoclonal Antibodies and T-Cell Hybridomas 563-681 (Elsevier, N.Y.). The term "monoclonal antibody" as used herein is not limited to antibodies produced through hybridoma technology. The term "monoclonal antibody" refers to an antibody that is derived from a single clone, including any eukaryotic, prokaryotic, or phage clone, and not the method by which it is produced. Hybridomas are selected, cloned and further screened for desirable characteristics, including robust hybridoma growth, high antibody production and desirable antibody characteristics, as discussed in Example 1 below. Hybridomas may be cultured and expanded in vivo in syngeneic animals, in animals that lack an immune system, e.g., nude mice, or in cell culture in vitro. Methods of selecting, cloning and expanding hybridomas are well known to those of ordinary skill in the art. In a particular embodiment, the hybridomas are mouse hybridomas. In another embodiment, the hybridomas are produced in a non-human, non-mouse species such as rats, sheep, pigs, goats, cattle or horses. In another embodiment, the hybridomas are human hybridomas, in which a human non-secretory myeloma is fused with a human cell expressing an antibody that binds a specific antigen.

Recombinant mAbs are also generated from single, isolated lymphocytes using a procedure referred to in the art as the selected lymphocyte antibody method (SLAM), as described in U.S. Pat. No. 5,627,052; PCT Publication No. WO 92/02551; and Babcock, J. S. et al. (1996) Proc. Natl. Acad. Sci. USA 93:7843-7848. In this method, single cells secreting antibodies of interest, e.g., lymphocytes derived from an immunized animal, are identified, and, heavy- and light-chain variable region cDNAs are rescued from the cells by reverse transcriptase-PCR. These variable regions can then be expressed, in the context of appropriate immunoglobulin constant regions (e.g., human constant regions), in mammalian host cells, such as COS or CHO cells. The host cells transfected with the amplified immunoglobulin sequences, derived from in vivo selected lymphocytes, can then undergo further analysis and selection in vitro, for example by panning the transfected cells to isolate cells expressing antibodies to the antigen of interest. The amplified immunoglobulin sequences further can be manipulated in vitro, such as by in vitro affinity maturation methods such as those described in PCT Publication Nos. WO 97/29131 and WO 00/56772.

Monoclonal antibodies are also produced by immunizing a non-human animal comprising some, or all, of the human immunoglobulin locus with an antigen of interest. In an embodiment, the non-human animal is a XENOMOUSE transgenic mouse, an engineered mouse strain that comprises large fragments of the human immunoglobulin loci and is deficient in mouse antibody production. See, e.g., Green et al. (1994) Nature Genet. 7: 13-21 and U.S. Pat. Nos. 5,916,771; 5,939,598; 5,985,615; 5,998,209; 6,075,181; 6,091,001; 6,114,598; and 6,130,364. See also PCT Publication Nos. WO 91/10741; WO 94/02602; WO 96/34096; WO 96/33735; WO 98/16654; WO 98/24893; WO 98/50433; WO 99/45031; WO 99/53049; WO 00/09560; and WO 00/037504. The XENOMOUSE transgenic mouse produces an adult-like human repertoire of fully human antibodies, and generates antigen-specific human monoclonal antibodies. The XENOMOUSE transgenic mouse contains approximately 80% of the human antibody repertoire through introduction of megabase sized, germline configuration YAC fragments of the human heavy chain loci and x light chain loci. See Mendez et al. (1997) Nature Genet. 15: 146-156; Green and Jakobovits (1998) J. Exp. Med. 188: 483-495.

In vitro methods also can be used to make the parent antibodies, wherein an antibody library is screened to identify an antibody having the desired binding specificity. Methods for such screening of recombinant antibody libraries are well known in the art and include methods described in, for example, Ladner et al., U.S. Pat. No. 5,223,409; PCT Publication Nos. WO 92/18619; WO 91/17271; WO 92/20791; WO 92/15679; WO 93/01288; WO 92/01047; WO 92/09690 and WO 97/29131; Fuchs et al. (1991) Bio/Technology 9: 1370-1372; Hay et al. (1992) Hum. Antibod. Hybridomas 3: 81-85; Huse et al. (1989) Science 246: 1275-1281; McCafferty et al. (1990) Nature 348: 552-554; Griffiths et al. (1993) EMBO J. 12: 725-734; Hawkins et al. (1992) J. Mol. Biol. 226: 889-896; Clackson et al. (1991) Nature 352: 624-628; Gram et al. (1992) Proc. Natl. Acad. Sci. USA 89: 3576-3580; Garrad et al. (1991) Bio/Technology 9: 1373-1377; Hoogenboom et al. (1991) Nucl. Acid Res. 19: 4133-4137; and Barbas et al. (1991) Proc. Natl. Acad. Sci. USA 88: 7978-7982, and U.S. Patent Publication No. 2003/0186374.

Parent antibodies can also be generated using various phage display methods known in the art. In phage display methods, functional antibody domains are displayed on the surface of phage particles which carry the polynucleotide sequences encoding them. In a particular, such phage can be utilized to display antigen-binding domains expressed from a repertoire or combinatorial antibody library (e.g., human or murine). Phage expressing an antigen binding domain that binds the antigen of interest can be selected or identified with antigen, e.g., using labeled antigen or antigen bound or captured to a solid surface or bead. Phage used in these methods are typically filamentous phage including fd and M13 binding domains expressed from phage with Fab, Fv or disulfide stabilized Fv antibody domains recombinantly fused to either the phage gene III or gene VIII protein. Examples of phage display methods that can be used include those disclosed in Brinkman et al. (1995) J. Immunol. Methods 182: 41-50; Ames et al. (1995) J. Immunol. Methods 184: 177-186; Kettleborough et al. (1994) Eur. J. Immunol. 24: 952-958; Persic et al. (1997) Gene 187: 9-18; Burton et al. (1994) Advances in Immunol. 57: 191-280; PCT Application No. PCT/GB91/01134; PCT Publication Nos. WO 90/02809; WO 91/10737; WO 92/01047; WO 92/18619; WO 93/11236; WO 95/15982; and WO 95/20401; and U.S. Pat. Nos. 5,698,426; 5,223,409; 5,403,484; 5,580,717; 5,427,908; 5,750,753; 5,821,047; 5,571,698; 5,427,908; 5,516,637; 5,780,225; 5,658,727; 5,733,743 and 5,969,108.

As described in the herein references, after phage selection, the antibody coding regions from the phage can be isolated and used to generate whole antibodies including human antibodies or any other desired antigen binding fragment, and expressed in any desired host, including mammalian cells, insect cells, plant cells, yeast, and bacteria, e.g., as described in detail below. For example, techniques to produce recombinantly Fab, Fab' and F(ab')2 fragments can also be employed using methods known in the art such as those disclosed in PCT Publication No. WO 92/22324; Mullinax et al. (1992) BioTechniques 12(6): 864-869; Sawai et al. (1995) AJRI 34: 26-34; and Better et al. (1988) Science 240: 1041-1043. Examples of techniques, which can be used to produce single-chain Fvs and antibodies, include those described in U.S. Pat. Nos. 4,946,778 and 5,258,498; Huston et al. (1991), Methods Enzymol. 203:46-88; Shu et al. (1993) Proc. Natl. Acad. Sci. USA 90: 7995-7999; and Skerra et al. (1988) Science 240: 1038-1040.

Alternative to screening of recombinant antibody libraries by phage display, other methodologies known in the art for screening large combinatorial libraries can be applied to the identification of parent antibodies. One type of alternative expression system is one in which the recombinant antibody library is expressed as RNA-protein fusions, as described in PCT Publication No. WO 98/31700 and in Roberts, R. W. and Szostak, J. W. (1997) *Proc. Natl. Acad. Sci. USA* 94:12297-12302. In this system, a covalent fusion is created between an mRNA and the peptide or protein that it encodes by in vitro translation of synthetic mRNAs that carry puromycin, a peptidyl acceptor antibiotic, at their 3' end. Thus, a specific mRNA can be enriched from a complex mixture of mRNAs (e.g., a combinatorial library) based on the properties of the encoded peptide or protein, e.g., antibody, or portion thereof, such as binding of the antibody, or portion thereof, to the dual specificity antigen. Nucleic acid sequences encoding antibodies, or portions thereof, recovered from screening of such libraries can be expressed by recombinant means as described herein (e.g., in mammalian host cells) and, moreover, can be subjected to further affinity maturation by either additional rounds of screening of mRNA-peptide fusions in which mutations have been introduced into the originally selected sequence(s), or by other methods for affinity maturation in vitro of recombinant antibodies, as described herein.

In another approach the parent antibodies can also be generated using yeast display methods known in the art. In yeast display methods, genetic methods are used to tether antibody domains to the yeast cell wall and display them on the surface of yeast. In particular, such yeast can be utilized to display antigen-binding domains expressed from a repertoire or combinatorial antibody library (e.g., human or murine). Examples of yeast display methods that can be used to make the parent antibodies include those disclosed in U.S. Pat. No. 6,699,658.

The antibodies described herein can be further modified to generate CDR grafted and humanized parent antibodies. CDR-grafted parent antibodies comprise heavy and light chain variable region sequences from a human antibody wherein one or more of the CDR regions of $V_H$ and/or $V_L$ are replaced with CDR sequences of murine antibodies that bind an antigen of interest. A framework sequence from any human antibody may serve as the template for CDR grafting. However, straight chain replacement onto such a framework often leads to some loss of binding affinity to the antigen. The more homologous a human antibody is to the original murine antibody, the less likely the possibility that combining the murine CDRs with the human framework will introduce distortions in the CDRs that could reduce affinity. Therefore, in an embodiment, the human variable framework that is chosen to replace the murine variable framework apart from the CDRs have at least a 65% sequence identity with the murine antibody variable region framework. In an embodiment, the human and murine variable regions apart from the CDRs have at least 70% sequence identify. In a particular embodiment, that the human and murine variable regions apart from the CDRs have at least 75% sequence identity. In another embodiment, the human and murine variable regions apart from the CDRs have at least 80% sequence identity. Methods for producing such antibodies are known in the art (see EP 239,400; PCT Publication No. WO 91/09967; and U.S. Pat. Nos. 5,225,539; 5,530,101; and 5,585,089), veneering or resurfacing (EP 592,106; EP 519,596; Padlan (1991) Mol. Immunol. 28(4/5): 489-498; Studnicka et al. (1994) Prot. Engineer. 7(6): 805-814; and Roguska et al. (1994) Proc. Acad. Sci. USA 91: 969-973), chain shuffling (U.S. Pat. No. 5,565,352), and anti-idiotypic antibodies.

Humanized antibodies are antibody molecules from non-human species that bind the desired antigen and have one or more CDRs from the nonhuman species and framework regions from a human immunoglobulin molecule. Known human Ig sequences are disclosed, e.g., in Kabat et al., Sequences of Proteins of Immunological Interest, U.S. Dept. Health (1983) Such imported sequences can be used to reduce immunogenicity or reduce, enhance or modify binding, affinity, on-rate, off-rate, avidity, specificity, half-life, or any other suitable characteristic, as known in the art.

Framework residues in the human framework regions may be substituted with the corresponding residue from the CDR donor antibody to alter, e.g., improve, antigen binding. These framework substitutions are identified by methods well known in the art, e.g., by modeling of the interactions of the CDR and framework residues to identify framework residues important for antigen binding and sequence comparison to identify unusual framework residues at particular positions. (See, e.g., U.S. Pat. No. 5,585,089; Riechmann et al. (1988) Nature 332:323). Three-dimensional immunoglobulin models are commonly available and are familiar to those skilled in the art. Computer programs are available which illustrate and display probable three-dimensional conformational structures of selected candidate immunoglobulin sequences. Inspection of these displays permits analysis of the likely role of the residues in the functioning of the candidate immunoglobulin sequence, i.e., the analysis of residues that influence the ability of the candidate immunoglobulin to bind its antigen. In this way, FR residues can be selected and combined from the consensus and import sequences so that the desired antibody characteristic, such as increased affinity for the target antigen(s), is achieved. In general, the CDR residues are directly and most substantially involved in influencing antigen binding. Antibodies can be humanized using a variety of techniques known in the art, such as but not limited to those described in Jones et al. (1986) Nature 321: 522; Verhoeyen et al. (1988) Science 239: 1534; Sims et al. (1993) J. Immunol. 151: 2296; Chothia and Lesk (1987) J. Mol. Biol. 196: 901; Carter et al. (1992) Proc. Natl. Acad. Sci. USA 89: 4285; Presta et al. (1993) J. Immunol. 151: 2623; Padlan (1991) Mol. Immunol. 28(4/5): 489-498; Studnicka et al. (1994) Prot. Engineer. 7(6): 805-814; Roguska et al., (1994) Proc. Natl. Acad. Sci. USA 91: 969-973; PCT Publication No. WO 91/09967: US98/16280; US96/18978; US91/09630; US91/05939; US94/01234; GB89/01334; GB91/01134; GB92/01755; WO90/14443; WO90/14424; and WO90/14430; European Patent Publication Nos. EP 229246; EP 592,106; EP 519, 596; and EP 239,400; and U.S. Pat. Nos. 5,565,332; 5,723, 323; 5,976,862; 5,824,514; 5,817,483; 5,814,476; 5,763, 192; 5,723,323; 5,766,886; 5,714,352; 6,204,023; 6,180, 370; 5,693,762; 5,530,101; 5,585,089; 5,225,539; and 4,816,567.

B. Criteria for Selecting Parent Monoclonal Antibodies

An embodiment pertains to selecting parent antibodies with at least one or more properties desired in the DVD-Ig molecule. In an embodiment, the desired property is selected from one or more antibody parameters. In another embodiment, the antibody parameters are antigen specificity, affinity to antigen, potency, biological function, epitope recognition, stability, solubility, production efficiency, immunogenicity, pharmacokinetics, bioavailability, tissue cross reactivity, or orthologous antigen binding.

B.1. Affinity to Antigen

The desired affinity of a therapeutic mAb may depend upon the nature of the antigen, and the desired therapeutic end-point. In an embodiment, monoclonal antibodies have higher affinities (Kd=0.01-0.50 pM) when blocking a cytokine-cytokine receptor interaction as such interactions are usually high affinity interactions (e.g., <pM-<nM ranges). In such instances, the mAb affinity for its target should be equal to or better than the affinity of the cytokine (ligand) for its receptor. On the other hand, mAb with lesser affinity (>nM range) could be therapeutically effective e.g., in clearing circulating potentially pathogenic proteins e.g., monoclonal antibodies that bind to, sequester, and clear circulating species of A-β amyloid. In other instances, reducing the affinity of an existing high affinity mAb by site-directed mutagenesis or using a mAb with lower affinity for its target could be used to avoid potential side-effects e.g., a high affinity mAb may sequester/neutralize all of its intended target, thereby completely depleting/eliminating the function(s) of the targeted protein. In this scenario, a low affinity mAb may sequester/neutralize a fraction of the target that may be responsible for the disease symptoms (the pathological or over-produced levels), thus allowing a fraction of the target to continue to perform its normal physiological function(s). Therefore, it may be possible to reduce the Kd to adjust dose and/or reduce side-effects. The affinity of the parental mAb might play a role in appropriately targeting cell surface molecules to achieve desired therapeutic out-come. For example, if a target is expressed on cancer cells with high density and on normal cells with low density, a lower affinity mAb will bind a greater number of targets on tumor cells than normal cells, resulting in tumor cell elimination via ADCC or CDC, and therefore might have therapeutically desirable effects. Thus selecting a mAb with desired affinity may be relevant for both soluble and surface targets.

Signaling through a receptor upon interaction with its ligand may depend upon the affinity of the receptor-ligand interaction. Similarly, it is conceivable that the affinity of a mAb for a surface receptor could determine the nature of intracellular signaling and whether the mAb may deliver an agonist or an antagonist signal. The affinity-based nature of mAb-mediated signaling may have an impact of its side-effect profile. Therefore, the desired affinity and desired functions of therapeutic monoclonal antibodies need to be determined carefully by in vitro and in vivo experimentation.

The desired Kd of a binding protein (e.g., an antibody) may be determined experimentally depending on the desired therapeutic outcome. In an embodiment parent antibodies with affinity (Kd) for a particular antigen equal to, or better than, the desired affinity of the DVD-Ig for the same antigen are selected. The parent antibodies for a given DVD-Ig molecule can be the same antibody or different antibodies. The antigen binding affinity and kinetics are assessed by Biacore or another similar technique. In one embodiment, each parent antibody has a dissociation constant (Kd) to its antigen of: at most about $10^{-7}$M; at most about $10^{-8}$M; at most about $10^{-9}$M; at most about $10^{-10}$M; at most about $10^{-11}$M; at most about $10^{-12}$M; or at most $10^{-13}$M. The first parent antibody from which VD1 is obtained and the second parent antibody from which VD2 is obtained may have similar or different affinity ($K_D$) for the respective antigen. Each parent antibody has an on rate constant (Kon) to the antigen of: at least about $10^2 M^{-1} s^{-1}$; at least about $10^3 M^{-1} s^{-1}$; at least about $10^4 M^{-1} s^{-1}$; at least about $10^5 M^{-1} s^{-1}$; or at least about $10^6 M^{-1} s^{-1}$, as measured by surface plasmon resonance. The first parent antibody from which VD1 is obtained and the second parent antibody from which VD2 is obtained may have similar or different on rate constant (Kon) for the respective antigen. In one embodiment, each parent antibody has an off rate constant (Koff) to the antigen of: at most about $10^6 M^{-3} s^{-1}$; at most about $10^{-4} s^{-1}$; at most about $10^{-5} s^{-1}$; or at most about $10^{-6} s^{-1}$, as measured by surface plasmon resonance. The first parent antibody from which VD1 is obtained and the second parent antibody from which VD2 is obtained may have similar or different off rate constants (Koff) for the respective antigen.

B.2. Potency

The desired affinity/potency of parental monoclonal antibodies will depend on the desired therapeutic outcome. For example, for receptor-ligand (R-L) interactions the affinity (kd) is equal to or better than the R-L kd (pM range). For simple clearance of a pathologic circulating protein, the kd could be in low nM range e.g., clearance of various species of circulating A-β peptide. In addition, the kd will also depend on whether the target expresses multiple copies of the same epitope e.g., a mAb targeting conformational epitope in Aβ oligomers.

Where VD1 and VD2 bind the same antigen, but distint epitopes, the DVD-Ig will contain four binding sites for the same antigen, thus increasing avidity and thereby the apparent kd of the DVD-Ig. In an embodiment, parent antibodies with equal or lower kd than that desired in the DVD-Ig are chosen. The affinity considerations of a parental mAb may also depend upon whether the DVD-Ig contains four or more identical antigen binding sites (i.e., a DVD-Ig from a single mAb). In this case, the apparent kd would be greater than the mAb due to avidity. Such DVD-Igs can be employed for cross-linking surface receptor, increase neutralization potency, enhance clearance of pathological proteins, etc.

In an embodiment parent antibodies with neutralization potency for specific antigen equal to or better than the desired neutralization potential of the DVD-Ig for the same antigen are selected. The neutralization potency can be assessed by a target-dependent bioassay where cells of appropriate type produce a measurable signal (i.e., proliferation or cytokine production) in response to target stimulation, and target neutralization by the mAb can reduce the signal in a dose-dependent manner.

B.3. Biological Functions

Monoclonal antibodies can perform potentially several functions. Some of these functions are listed in Table 1. These functions can be assessed by both in vitro assays (e.g., cell-based and biochemical assays) and in vivo animal models.

TABLE 1

Some Potential Applications For Therapeutic Antibodies

| Target (Class) | Mechanism of Action (target) |
|---|---|
| Soluble (cytokines, other) | Neutralization of activity (e.g., a cytokine) Enhance clearance (e.g., Aβ oligomers) Increase half-life (e.g., GLP 1) |
| Cell Surface (Receptors, other) | Agonist (e.g., GLP1 R; EPO R; etc.) Antagonist (e.g., integrins; etc.) Cytotoxic (CD 20; etc.) |
| Protein deposits | Enhance clearance/degradation (e.g., Aβ plaques, amyloid deposits) |

MAbs with distinct functions described in the examples herein in Table 1 can be selected to achieve desired therapeutic outcomes. Two or more selected parent monoclonal antibodies can then be used in DVD-Ig format to achieve two distinct functions in a single DVD-Ig molecule. For example, a DVD-Ig can be generated by selecting a parent mAb that neutralizes function of a specific cytokine, and selecting a parent mAb that enhances clearance of a pathological protein. Similarly, two parent monoclonal antibodies that recognize two different cell surface receptors can be selected, e.g., one mAb with an agonist function on one receptor and the other mAb with an antagonist function on a different receptor. These two selected monoclonal antibodies each with a distinct function, can be used to construct a single DVD-Ig molecule that will possess the two distinct functions (agonist and antagonist) of the selected monoclonal antibodies in a single molecule. Similarly, two antagonistic monoclonal antibodies to cell surface receptors each blocking binding of respective receptor ligands (e.g., EGF and IGF), can be used in a DVD-Ig format. Conversely, an antagonistic anti-receptor mAb (e.g., anti-EGFR) and a neutralizing anti-soluble mediator (e.g., anti-IGF1/2) mAb can be selected to make a DVD-Ig.

B.4. Epitope Recognition

Different regions of proteins may perform different functions. For example specific regions of a cytokine interact with the cytokine receptor to bring about receptor activation whereas other regions of the protein may be required for stabilizing the cytokine. In this instance one may select a mAb that binds specifically to the receptor interacting region(s) on the cytokine and thereby blocks cytokine-receptor interaction. In some cases, for example, certain chemokine receptors that bind multiple ligands, a mAb that binds to the epitope (region on chemokine receptor) that interacts with only one ligand can be selected. In other instances, monoclonal antibodies can bind to epitopes on a target that are not directly responsible for physiological functions of the protein, but binding of a mAb to these regions could either interfere with physiological functions (steric hindrance) or alter the conformation of the protein such that the protein cannot function (mAb to receptors with multiple ligand which alter the receptor conformation such that none of the ligand can bind). Anti-cytokine monoclonal antibodies that do not block binding of the cytokine to its receptor, but block signal transduction have also been identified (e.g., 125-2H, an anti-IL-1β mAb).

Examples of epitopes and mAb functions include, but are not limited to, blocking Receptor-Ligand (R-L) interaction (neutralizing mAb that binds R-interacting site); steric hindrance resulting in diminished or no R-binding. An Ab can bind the target at a site other than a receptor binding site, but still interfere with receptor binding and functions of the target by inducing conformational change and eliminating function (e.g., Xolair), e.g., binding to R but blocking signaling (125-2H).

In an embodiment, the parental mAb needs to target the appropriate epitope for maximum efficacy. Such epitope should be conserved in the DVD-Ig. The binding epitope of a mAb can be determined by several approaches, including co-crystallography, limited proteolysis of mAb-antigen complex plus mass spectrometric peptide mapping (Legros V. et al. (2000) Protein Sci. 9:1002-10), phage displayed peptide libraries (O'Connor, K. H. et al. (2005) J. Immunol. Methods. 299:21-35), as well as mutagenesis (Wu C. et al. (2003) J. Immunol. 170:5571-7).

B.5. Physicochemical and Pharmaceutical Properties

Therapeutic treatment with antibodies often requires administration of high doses, often several mg/kg (due to a low potency on a mass basis as a consequence of a typically large molecular weight). In order to accommodate patient compliance and to address adequately chronic disease therapies and outpatient treatment, subcutaneous (s.c.) or intramuscular (i.m.) administration of therapeutic mAbs is desirable. For example, the maximum desirable volume for s.c. administration is ~1.0 mL, and therefore, concentrations of >100 mg/mL are desirable to limit the number of injections per dose. In an embodiment, the therapeutic antibody is administered in one dose. The development of such formulations is constrained, however, by protein-protein interactions (e.g., aggregation, which potentially increases immunogenicity risks) and by limitations during processing and delivery (e.g., viscosity). Consequently, the large quantities required for clinical efficacy and the associated development constraints limit full exploitation of the potential of antibody formulation and s.c. administration in high-dose regimens. It is apparent that the physicochemical and pharmaceutical properties of a protein molecule and the protein solution are of utmost importance, e.g., stability, solubility and viscosity features.

B.5.1. Stability

A "stable" antibody formulation is one in which the antibody therein essentially retains its physical stability and/or chemical stability and/or biological activity upon storage. Stability can be measured at a selected temperature for a selected time period. In an embodiment, the antibody in the formulation is stable at room temperature (about 30° C.) or at 40° C. for at least 1 month and/or stable at about 2-8° C. for at least 1 year, such as, for at least 2 years. Furthermore, in an embodiment, the formulation is stable following freezing (to, e.g., −70° C.) and thawing of the formulation, hereinafter referred to as a "freeze/thaw cycle." In another example, a "stable" formulation may be one wherein less than about 10% and less than about 5% of the protein is present as an aggregate in the formulation.

A DVD-Ig stable that is in vitro at various temperatures for an extended time period is desirable. One can achieve this by rapid screening of parental mAbs that are stable in vitro at elevated temperature, e.g., at 40° C. for 2-4 weeks, and then assess stability. During storage at 2-8° C., the protein reveals stability for at least 12 months, e.g., at least 24 months. Stability (% of monomeric, intact molecule) can be assessed using various techniques such as cation exchange chromatography, size exclusion chromatography, SDS-PAGE, as well as bioactivity testing. For a more comprehensive list of analytical techniques that may be employed to analyze covalent and conformational modifications see Jones, A. J. S. (1993) Analytical methods for the assessment of protein formulations and delivery systems. In: Cleland, J. L.; Langer, R., editors. Formulation and delivery of peptides and proteins, 1$^{st}$ edition, Washington, ACS, pg. 22-45; and Pearlman, R.; Nguyen, T. H. (1990) Analysis of protein drugs. In: Lee, V. H., editor. Peptide and protein drug delivery, 1st edition, New York, Marcel Dekker, Inc., pg. 247-301.

Heterogeneity and aggregate formation: stability of the antibody may be such that the formulation may reveal less than about 10%, such as less than about 5%, such as less than about 2%, or, within the range of 0.5% to 1.5% or less in the GMP antibody material that is present as aggregate. Size exclusion chromatography is a method that is sensitive, reproducible, and very robust in the detection of protein aggregates.

In addition to low aggregate levels, the antibody must, in an embodiment, be chemically stable. Chemical stability may be determined by ion exchange chromatography (e.g., cation or anion exchange chromatography), hydrophobic interaction chromatography, or other methods such as isoelectric focusing or capillary electrophoresis. For instance, chemical stability of the antibody may be such that after storage of at least 12 months at 2-8° C. the peak representing unmodified antibody in a cation exchange chromatography may increase not more than 20%, such as not more than 10%, or not more than 5% as compared to the antibody solution prior to storage testing.

In an embodiment, the parent antibodies display structural integrity; correct disulfide bond formation, and correct folding. Chemical instability due to changes in secondary or tertiary structure of an antibody may impact antibody activity. For instance, stability, as indicated by activity of the antibody may be such that after storage of at least 12 months at 2-8° C., the activity of the antibody may decrease not more than 50%, such as not more than 30%, not more than 10%, or not more than 5% or 1% as compared to the antibody solution prior to storage testing. Suitable antigen-binding assays can be employed to determine antibody activity.

B.5.2. Solubility

The "solubility" of a mAb correlates with the production of correctly folded, monomeric IgG. The solubility of the IgG may therefore be assessed by HPLC. For example, soluble (monomeric) IgG will give rise to a single peak on the HPLC chromatograph, whereas insoluble (e.g., multimeric and aggregated) will give rise to a plurality of peaks. A person skilled in the art will therefore be able to detect an increase or decrease in solubility of an IgG using routine HPLC techniques. For a more comprehensive list of analytical techniques that may be employed to analyze solubility (see Jones, A. G. (1993) Dep. Chem. Biochem. Eng., Univ. Coll. London, London, UK. Editor(s): Shamlou, P. Ayazi. Process. Solid-Liq. Suspensions, 93-117. Publisher: Butterworth-Heinemann, Oxford, UK and Pearlman et al. (1990) Adv. in Parenteral Sci. 4 (Pept. Protein Drug Delivery): 247-301). Solubility of a therapeutic mAb is critical for formulating to high concentration often required for adequate dosing. As outlined herein, solubilities of >100 mg/mL may be required to accommodate efficient antibody dosing. For instance, antibody solubility may be not less than about 5 mg/mL in early research phase, not less than about 25 mg/mL in advanced process science stages, or not less than about 100 mg/mL, or not less than about 150 mg/mL. It is obvious to a person skilled in the art that the intrinsic properties of a protein molecule are important the physico-chemical properties of the protein solution, e.g., stability, solubility, viscosity. However, a person skilled in the art will appreciate that a broad variety of excipients exist that may be used as additives to beneficially impact the characteristics of the final protein formulation. These excipients may include: (i) liquid solvents, cosolvents (e.g., alcohols such as ethanol); (ii) buffering agents (e.g., phosphate, acetate, citrate, and amino acid buffers); (iii) sugars or sugar alcohols (e.g., sucrose, trehalose, fructose, raffinose, mannitol, sorbitol, and dextrans); (iv) surfactants (e.g., polysorbate 20, 40, 60, 80, and poloxamers); (v) isotonicity modifiers (e.g., salts such as NaCl, sugars, and sugar alcohols); and (vi) others (e.g., preservatives, chelating agents, antioxidants, chelating substances (e.g., EDTA), biodegradable polymers, and carrier molecules (e.g., HSA and PEGs)).

Viscosity is a parameter of high importance with regard to antibody manufacture and antibody processing (e.g., diafiltration/ultrafiltration), fill-finish processes (pumping aspects, filtration aspects) and delivery aspects (syringeability, sophisticated device delivery). Low viscosities enable the liquid solution of the antibody having a higher concentration. This enables the same dose may be administered in smaller volumes. Small injection volumes inhere the advantage of lower pain on injection sensations, and the solutions not necessarily have to be isotonic to reduce pain on injection in the patient. The viscosity of the antibody solution may be such that at shear rates of 100 (1/s) antibody solution viscosity is below 200 mPa s, below 125 mPa s, below 70 mPa s, and below 25 mPa s, or even below 10 mPa s.

B.5.3. Production Efficiency

The generation of a DVD-Ig that is efficiently expressed in mammalian cells, such as Chinese hamster ovary cells (CHO), will in an embodiment require two parental monoclonal antibodies, which are themselves expressed efficiently in mammalian cells. The production yield from a stable mammalian line (i.e., CHO) should be above about 0.5 g/L, above about 1 g/L, or in the range of about 2 to about 5 g/L or more (Kipriyanov, S. M. and Little, M. (1999) Mol. Biotechnol. 12: 173-201; Carroll, S, and Al-Rubeai, M. (2004) Expert Opin. Biol. Ther. 4: 1821-9).

Production of antibodies and Ig fusion proteins in mammalian cells is influenced by several factors. Engineering of the expression vector via incorporation of strong promoters, enhancers and selection markers can maximize transcription of the gene of interest from an integrated vector copy. The identification of vector integration sites that are permissive for high levels of gene transcription can augment protein expression from a vector (Wurm et al. (2004) Nature Biotechnol. 22(11): 1393-1398). Furthermore, levels of production are affected by the ratio of antibody heavy and light chains and various steps in the process of protein assembly and secretion (Jiang et al. (2006) Biotechnol. Prog. 22(1): 313-8).

B.6. Immunogenicity

Administration of a therapeutic mAb may result in certain incidence of an immune response (i.e., the formation of endogenous antibodies directed against the therapeutic mAb). Potential elements that might induce immunogenicity should be analyzed during selection of the parental monoclonal antibodies, and steps to reduce such risk can be taken to optimize the parental monoclonal antibodies prior to DVD-Ig construction. Mouse-derived antibodies have been found to be highly immunogenic in patients. The generation of chimeric antibodies comprised of mouse variable and human constant regions presents a logical next step to reduce the immunogenicity of therapeutic antibodies (Morrison and Schlom, 1990). Alternatively, immunogenicity can be reduced by transferring murine CDR sequences into a human antibody framework (reshaping/CDR grafting/humanization), as described for a therapeutic antibody by Riechmann et al. (1988) Nature 332: 323-327. Another method is referred to as "resurfacing" or "veneering," starting with the rodent variable light and heavy domains, only surface-accessible framework amino acids are altered to human ones, while the CDR and buried amino acids remain from the parental rodent antibody (Roguska et al. (1996) Prot. Engineer 9: 895-904). In another type of humanization, instead of grafting the entire CDRs, one technique grafts only the "specificity-determining regions" (SDRs), defined as the subset of CDR residues that are involved in binding of the antibody to its target (Kashmiri et al. (2005) Methods 36(1): 25-34). This necessitates identification of the SDRs either through analysis of available three-dimensional structures of antibody-target complexes or mutational analysis of the antibody CDR residues to determine which interact with the target. Alternatively, fully human antibodies may have reduced immunogenicity compared to murine, chimeric or humanized antibodies.

Another approach to reduce the immunogenicity of therapeutic antibodies is the elimination of certain specific sequences that are predicted to be immunogenic. In one approach, after a first generation biologic has been tested in humans and found to be unacceptably immunogenic, the B-cell epitopes can be mapped and then altered to avoid immune detection. Another approach uses methods to predict and remove potential T-cell epitopes. Computational methods have been developed to scan and to identify the peptide sequences of biologic therapeutics with the potential to bind to MHC proteins (Desmet et al. (2005) Proteins 58: 53-69). Alternatively a human dendritic cell-based method can be used to identify $CD4^+$ T-cell epitopes in potential protein allergens (Stickler et al. (2000) J. Immunother. 23: 654-60; S. L. Morrison and J. Schlom (1990) Important Adv. Oncol. 3-18; Riechmann et al. (1988) Nature 332: 323-327; Roguska et al. (1996) Protein Engineer. 9: 895-904; Kashmiri et al. (2005) Methods 36(1): 25-34; Desmet et al. (2005) Proteins 58: 53-69; and Stickler et al. (2000) J. Immunotherapy 23: 654-60.)

B.7. In Vivo Efficacy

To generate a DVD-Ig molecule with desired in vivo efficacy, it is important to generate and select mAbs with similarly desired in vivo efficacy when given in combination. However, in some instances the DVD-Ig may exhibit in vivo efficacy that cannot be achieved with the combination of two separate mAbs. For instance, a DVD-Ig may bring two targets in close proximity leading to an activity that cannot be achieved with the combination of two separate mAbs. Additional desirable biological functions are described herein in section B 3. Parent antibodies with characteristics desirable in the DVD-Ig molecule may be selected based on factors such as pharmacokinetic t ½; tissue distribution; soluble versus cell surface targets; and target concentration—soluble/density-surface.

B.8. In Vivo Tissue Distribution

To generate a DVD-Ig molecule with desired in vivo tissue distribution, in an embodiment parent mAbs with similar desired in vivo tissue distribution profile must be selected. In this regard, the parent mAbs can be the same antibody or different antibodies. Alternatively, based on the mechanism of the dual-specific targeting strategy, it may at other times not be required to select parent mAbs with the similarly desired in vivo tissue distribution when given in combination. (e.g., in the case of a DVD-Ig in which one binding component targets the DVD-Ig to a specific site thereby bringing the second binding component to the same target site). For example, one binding specificity of a DVD-Ig could target pancreas (islet cells) and the other specificity could bring GLP1 to the pancreas to induce insulin.

B.9. Isotype

To generate a DVD-Ig molecule with desired properties including, but not limited to, isotype, effector functions, and the circulating half-life, in an embodiment parent mAbs with appropriate Fc-effector functions depending on the therapeutic utility and the desired therapeutic end-point are selected. The parent mAbs can be the same antibody or different antibodies. There are five main heavy-chain classes or isotypes, some of which have several sub-types, and these determine the effector functions of an antibody molecule. These effector functions reside in the hinge region, CH2 and CH3 domains of the antibody molecule. However, residues in other parts of an antibody molecule may have effects on effector functions as well. The hinge region Fc-effector functions include: (i) antibody-dependent cellular cytotoxicity, (ii) complement (C1q) binding, activation and complement-dependent cytotoxicity (CDC), (iii) phagocytosis/clearance of antigen-antibody complexes, and (iv) cytokine release in some instances. These Fc-effector functions of an antibody molecule are mediated through the interaction of the Fc-region with a set of class-specific cell surface receptors. Antibodies of the IgG1 isotype are most active while IgG2 and IgG4 having minimal or no effector functions. The effector functions of the IgG antibodies are mediated through interactions with three structurally homologous cellular Fc receptor types (and sub-types) (FcgRI, FcgRII and FcgRIII). These effector functions of an IgG1 can be eliminated by mutating specific amino acid residues in the lower hinge region (e.g., L234A, L235A) that are required for FcgR and C1q binding. Amino acid residues in the Fc region, in particular the CH2-CH3 domains, also determine the circulating half-life of the antibody molecule. This Fc function is mediated through the binding of the Fc-region to the neonatal Fc receptor (FcRn), which is responsible for recycling of antibody molecules from the acidic lysosomes back to the general circulation.

Whether a mAb should have an active or an inactive isotype will depend on the desired therapeutic end-point for an antibody. Some examples of usage of isotypes and desired therapeutic outcome are listed below:
a) If the desired end-point is functional neutralization of a soluble cytokine, then an inactive isotype may be used;
b) If the desired out-come is clearance of a pathological protein, an active isotype may be used;
c) If the desired out-come is clearance of protein aggregates, an active isotype may be used;
d) If the desired outcome is to antagonize a surface receptor, an inactive isotype is used (Tysabri, IgG4; OKT3, mutated IgG1);
e) If the desired outcome is to eliminate target cells, an active isotype is used (Herceptin, IgG1 (and with enhanced effector functions); and
f) If the desired outcome is to clear proteins from circulation without entering the CNS, an IgM isotype may be used (e.g., clearing circulating Ab peptide species).

The Fc effector functions of a parental mAb can be determined by various in vitro methods well known in the art.

As discussed, the selection of isotype, and thereby the effector functions will depend upon the desired therapeutic end-point. In cases where simple neutralization of a circulating target is desired, for example, blocking receptor-ligand interactions, the effector functions may not be required. In such instances isotypes or mutations in the Fc-region of an antibody that eliminate effector functions are desirable. In other instances, where elimination of target cells is the therapeutic end-point, for example, elimination of tumor cells, isotypes or mutations or de-fucosylation in the Fc-region that enhance effector functions are desirable (Presta, G. L. (2006) Adv. Drug Deliv. Rev. 58:640-656 and Satoh, M. et al. (2006) Expert Opin. Biol. Ther. 6: 1161-1173). Similarly, depending up on the therapeutic utility, the circulating half-life of an antibody molecule can be reduced/prolonged by modulating antibody-FcRn interactions by introducing specific mutations in the Fc region (Dall'Acqua, W. F. et al. (2006) J. Biol. Chem. 281: 23514-23524; Petkova, S. B. (2006) et al., Internat. Immunol. 18:1759-1769; Vaccaro, C. et al. (2007) Proc. Natl. Acad. Sci. USA 103: 18709-18714).

The published information on the various residues that influence the different effector functions of a normal therapeutic mAb may need to be confirmed for DVD-Ig. It may be possible that in a DVD-Ig format additional (different) Fc-region residues, other than those identified for the modulation of monoclonal antibody effector functions, may be important.

Overall, the decision as to which Fc-effector functions (isotype) will be critical in the final DVD-Ig format will depend upon the disease indication, therapeutic target, and desired therapeutic end-point and safety considerations. Listed below are exemplary appropriate heavy chain and light chain constant regions including, but not limited to:
IgG1—allotype: G1mz
IgG1 mutant—A234, A235
IgG2—allotype: G2m(n−)
Kappa—Km3
Lambda Fc Receptor and C1q Studies:

The possibility of unwanted antibody-dependent cell-mediated cytotoxicity (ADCC) and complement-dependent cytotoxicity (CDC) by antibody complexing to any overexpressed target on cell membranes can be abrogated by the (for example, L234A, L235A) hinge-region mutations. These substituted amino acids, present in the IgG1 hinge region of mAb, are expected to result in diminished binding of mAb to human Fc receptors (but not FcRn), as FcgR binding is thought to occur within overlapping sites on the IgG1 hinge region. This feature of mAb may lead to an improved safety profile over antibodies containing a wild-type IgG. Binding of mAb to human Fc receptors can be determined by flow cytometry experiments using cell lines (e.g., THP-1, K562) and an engineered CHO cell line that expresses FcgRIIb (or other FcgRs). Compared to IgG1 control monoclonal antibodies, mAb show reduced binding to FcgRI and FcgRIIa, whereas binding to FcgRIIb is unaffected. The binding and activation of C1q by antigen/IgG immune complexes triggers the classical complement cascade with consequent inflammatory and/or immunoregulatory responses. The C1q binding site on IgGs has been localized to residues within the IgG hinge region. C1q binding to increasing concentrations of mAb was assessed by C1q ELISA. The results demonstrate that mAb is unable to bind to C1q, as expected when compared to the binding of a wildtype control IgG1. Overall, the L234A, L235A hinge region mutation abolishes binding of mAb to FcgRI, FcgRIIa and C1q but does not impact the interaction of mAb with FcgRIIb. These data suggest that in vivo, mAb with mutant Fc will interact normally with the inhibitory FcgRIIb but will likely fail to interact with the activating FcgRI and FcgRIIa receptors or C1q.

Human FcRn Binding:

The neonatal receptor (FcRn) is responsible for transport of IgG across the placenta and to control the catabolic half-life of the IgG molecules. It might be desirable to increase the terminal half-life of an antibody to improve efficacy, to reduce the dose or frequency of administration, or to improve localization to the target. Alternatively, it might be advantageous to do the converse that is, to decrease the terminal half-life of an antibody to reduce whole body exposure or to improve the target-to-non-target binding ratios. Tailoring the interaction between IgG and its salvage receptor, FcRn, offers a way to increase or decrease the terminal half-life of IgG. Proteins in the circulation, including IgG, are taken up in the fluid phase through micropinocytosis by certain cells, such as those of the vascular endothelia. IgG can bind FcRn in endosomes under slightly acidic conditions (pH 6.0-6.5) and can recycle to the cell surface, where it is released under almost neutral conditions (pH 7.0-7.4). Mapping of the Fc-region-binding site on FcRn80, 16, 17 showed that two histidine residues that are conserved across species, His310 and His435, are responsible for the pH dependence of this interaction. Using phage-display technology, a mouse Fc-region mutation that increases binding to FcRn and extends the half-life of mouse IgG was identified (see Victor, G. et al. (1997) Nature Biotechnol. 15(7): 637-640). Fc-region mutations that increase the binding affinity of human IgG for FcRn at pH 6.0, but not at pH 7.4, have also been identified (see Dall'Acqua, William F., et al. (2002) J. Immunol. 169(9): 5171-80). Moreover, in one case, a similar pH-dependent increase in binding (up to 27-fold) was also observed for rhesus FcRn, and this resulted in a twofold increase in serum half-life in rhesus monkeys compared with the parent IgG (see Hinton, P. R. et al. (2004) J. Biol. Chem. 279(8), 6213-6216). These findings indicate that it is feasible to extend the plasma half-life of antibody therapeutics by tailoring the interaction of the Fc region with FcRn. Conversely, Fc-region mutations that attenuate interaction with FcRn can reduce antibody half-life.

B.10. Pharmacokinetics (PK)

To generate a DVD-Ig molecule with desired pharmacokinetic profile, in an embodiment parent mAbs with the similarly desired pharmacokinetic profile are selected. One consideration is that immunogenic response to monoclonal antibodies (i.e., HAHA, human anti-human antibody response; HACA, human anti-chimeric antibody response) further complicates the pharmacokinetics of these therapeutic agents. In an embodiment, monoclonal antibodies with minimal or no immunogenicity are used for constructing DVD-Ig molecules such that the resulting DVD-Igs will also have minimal or no immunogenicity. Some of the factors that determine the PK of a mAb include, but are not limited to, intrinsic properties of the mAb (VH amino acid sequence); immunogenicity; FcRn binding and Fc functions.

The PK profile of selected parental monoclonal antibodies can be easily determined in rodents as the PK profile in rodents correlates well with (or closely predicts) the PK profile of monoclonal antibodies in cynomolgus monkey and humans. The PK profile is determined as described in Example section 1.2.2.3.A.

After the parental monoclonal antibodies with desired PK characteristics (and other desired functional properties as discussed herein) are selected, the DVD-Ig is constructed. As the DVD-Ig molecules contain two antigen-binding domains from two parental monoclonal antibodies, the PK properties of the DVD-Ig are assessed as well. Therefore, while determining the PK properties of the DVD-Ig, PK assays may be employed that determine the PK profile based on functionality of both antigen-binding domains derived from the two parent monoclonal antibodies. The PK profile of a DVD-Ig can be determined as described in Example 1.2.2.3.A. Additional factors that may impact the PK profile of DVD-Ig include the antigen-binding domain (CDR) orientation; linker size; and Fc/FcRn interactions. PK characteristics of parent antibodies can be evaluated by assessing the following parameters: absorption, distribution, metabolism and excretion.

Absorption:

To date, administration of therapeutic monoclonal antibodies is via parenteral routes (e.g., intravenous [IV], subcutaneous [SC], or intramuscular [IM]). Absorption of a mAb into the systemic circulation following either SC or IM administration from the interstitial space is primarily through the lymphatic pathway. Saturable, presystemic, proteolytic degradation may result in variable absolute bioavailability following extravascular administration. Usually, increases in absolute bioavailability with increasing doses of monoclonal antibodies may be observed due to saturated proteolytic capacity at higher doses. The absorption process for a mAb is usually quite slow as the lymph fluid drains slowly into the vascular system, and the duration of absorption may occur over hours to several days. The absolute bioavailability of monoclonal antibodies following SC administration generally ranges from 50% to 100%. In the case of a transport-mediating structure at the blood-brain barrier targeted by the DVD-Ig construct, circulation times in plasma may be reduced due to enhanced trans-cellular transport at the blood brain barrier (BBB) into the CNS compartment, where the DVD-Ig is liberated to enable interaction via its second antigen recognition site.

Distribution:

Following IV administration, monoclonal antibodies usually follow a biphasic serum (or plasma) concentration-time profile, beginning with a rapid distribution phase, followed by a slow elimination phase. In general, a biexponential pharmacokinetic model best describes this kind of pharmacokinetic profile. The volume of distribution in the central compartment (Vc) for a mAb is usually equal to or slightly larger than the plasma volume (2-3 liters). A distinct biphasic pattern in serum (plasma) concentration versus time profile may not be apparent with other parenteral routes of administration, such as IM or SC, because the distribution phase of the serum (plasma) concentration-time curve is masked by the long absorption portion. Many factors, including physicochemical properties, site-specific and target-oriented receptor mediated uptake, binding capacity of tissue, and mAb dose can influence biodistribution of a mAb. Some of these factors can contribute to nonlinearity in biodistribution for a mAb.

Metabolism and Excretion:

Due to the molecular size, intact monoclonal antibodies are not excreted into the urine via kidney. They are primarily inactivated by metabolism (e.g., catabolism). For IgG-based therapeutic monoclonal antibodies, half-lives typically ranges from hours or 1-2 days to over 20 days. The elimination of a mAb can be affected by many factors, including, but not limited to, affinity for the FcRn receptor, immunogenicity of the mAb, the degree of glycosylation of the mAb, the susceptibility for the mAb to proteolysis, and receptor-mediated elimination.

B.11. Tissue Cross-Reactivity Pattern on Human and Tox Species

Identical staining pattern suggests that potential human toxicity can be evaluated in tox species. Tox species are those animal in which unrelated toxicity is studied.

The individual antibodies are selected to meet two criteria: (1) tissue staining appropriate for the known expression of the antibody target; and (2) similar staining pattern between human and tox species tissues from the same organ.

Criterion 1: Immunizations and/or antibody selections typically employ recombinant or synthesized antigens (proteins, carbohydrates or other molecules). Binding to the natural counterpart and counterscreen against unrelated antigens are often part of the screening funnel for therapeutic antibodies. However, screening against a multitude of antigens is often unpractical. Therefore tissue cross-reactivity studies with human tissues from all major organs serve to rule out unwanted binding of the antibody to any unrelated antigens.

Criterion 2: Comparative tissue cross reactivity studies with human and tox species tissues (cynomolgus monkey, dog, possibly rodents and others, the same 36 or 37 tissues are being tested as in the human study) help to validate the selection of a tox species. In the typical tissue cross-reactivity studies on frozen tissue sections therapeutic antibodies may demonstrate the expected binding to the known antigen and/or to a lesser degree binding to tissues based either on low level interactions (unspecific binding, low level binding to similar antigens, low level charge based interactions, etc.). In any case the most relevant toxicology animal species is the one with the highest degree of coincidence of binding to human and animal tissue.

Tissue cross reactivity studies follow the appropriate regulatory guidelines including EC CPMP Guideline III/5271/94 "Production and quality control of mAbs" and the 1997 U.S. FDA/CBER "Points to Consider in the Manufacture and Testing of Monoclonal Antibody Products for Human Use". Cryosections (5 µm) of human tissues obtained at autopsy or biopsy were fixed and dried on object glass. The peroxidase staining of tissue sections was performed, using the avidin-biotin system. FDA's Guidance "Points to Consider in the Manufacture and Testing of Monoclonal Antibody Products for Human Use".

Tissue cross reactivity studies are often done in two stages, with the first stage including cryosections of 32 tissues (typically: Adrenal Gland, Gastrointestinal Tract, Prostate, Bladder, Heart, Skeletal Muscle, Blood Cells, Kidney, Skin, Bone Marrow, Liver, Spinal Cord, Breast, Lung, Spleen, Cerebellum, Lymph Node, Testes, Cerebral Cortex, Ovary, Thymus, Colon, Pancreas, Thyroid, Endothelium, Parathyroid, Ureter, Eye, Pituitary, Uterus, Fallopian Tube and Placenta) from one human donor. In the second phase a full cross reactivity study is performed with up to 38 tissues (including adrenal, blood, blood vessel, bone marrow, cerebellum, cerebrum, cervix, esophagus, eye, heart, kidney, large intestine, liver, lung, lymph node, breast mammary gland, ovary, oviduct, pancreas, parathyroid, peripheral nerve, pituitary, placenta, prostate, salivary gland, skin, small intestine, spinal cord, spleen, stomach, striated muscle, testis, thymus, thyroid, tonsil, ureter, urinary bladder, and uterus) from 3 unrelated adults. Studies are done typically at minimally two dose levels.

The therapeutic antibody (i.e., test article) and isotype matched control antibody may be biotinylated for avidin-biotin complex (ABC) detection; other detection methods may include tertiary antibody detection for a FITC (or otherwise) labeled test article, or precomplexing with a labeled anti-human IgG for an unlabeled test article.

Briefly, cryosections (about 5 µm) of human tissues obtained at autopsy or biopsy are fixed and dried on object glass. The peroxidase staining of tissue sections is performed, using the avidin-biotin system. First (in case of a precomplexing detection system), the test article is incubated with the secondary biotinylated anti-human IgG and developed into immune complex. The immune complex at the final concentrations of 2 and 10 µg/mL of test article is added onto tissue sections on object glass and then the tissue sections are reacted for 30 minutes with a avidin-biotin-peroxidase kit. Subsequently, DAB (3,3'-diaminobenzidine), a substrate for the peroxidase reaction, is applied for 4 minutes for tissue staining. Antigen-Sepharose beads are used as positive control tissue sections.

Any specific staining is judged to be either an expected (e.g., consistent with antigen expression) or unexpected reactivity based upon known expression of the target antigen in question. Any staining judged specific is scored for intensity and frequency. Antigen or serum completion or blocking studies can assist further in determining whether observed staining is specific or nonspecific.

If two selected antibodies are found to meet the selection criteria—appropriate tissue staining, and matching staining between human and toxicology animal specific tissue—they can be selected for DVD-Ig generation.

The tissue cross-reactivity study has to be repeated with the final DVD-Ig construct, but while these studies follow the same protocol as outline herein, they are more complex to evaluate because any binding can come from any of the two parent antibodies, and any unexplained binding needs to be confirmed with complex antigen competition studies.

It is readily apparent that the complex undertaking of tissue crossreactivity studies with a multispecific molecule like a DVD-Ig is greatly simplified if the two parental antibodies are selected for (1) lack of unexpected tissue cross reactivity findings and (2) for appropriate similarity of tissue cross reactivity findings between the corresponding human and toxicology animal species tissues.

B.12. Specificity and Selectivity

To generate a DVD-Ig molecule with desired specificity and selectivity, one needs to generate and select parent mAbs with the similarly desired specificity and selectivity profile. In this regard, parent mAbs can be the same antibody or different antibodies.

Binding studies for specificity and selectivity with a DVD-Ig can be complex due to the four or more binding sites, two each for each antigen. Briefly, binding studies using an enzyme linked immunosorbent assay (ELISA), BIAcore, KinExA, or other interaction studies with a DVD-Ig need to monitor the binding of one, two or more antigens to the DVD-Ig molecule. While BIAcore technology can resolve the sequential, independent binding of multiple antigens, more traditional methods, including ELISA, or more modern techniques, such as KinExA, cannot. Therefore, careful characterization of each parent antibody is critical. After each individual antibody has been characterized for specificity, confirmation of specificity retention of the individual binding sites in the DVD-Ig molecule is greatly simplified.

It is readily apparent that the complex undertaking of determining the specificity of a DVD-Ig is greatly simplified if the two parental antibodies are selected for specificity prior to being combined into a DVD-Ig.

Antigen-antibody interaction studies can take many forms, including many classical protein protein interaction studies, ELISA, mass spectrometry, chemical cross-linking, SEC with light scattering, equilibrium dialysis, gel permeation, ultrafiltration, gel chromatography, large-zone analytical SEC, micropreparative ultracentrigugation (sedimentation equilibrium), spectroscopic methods, titration microcalorimetry, sedimentation equilibrium (in analytical ultracentrifuge), sedimentation velocity (in analytical centrifuge), and surface plasmon resonance (including BIAcore). Relevant references include "Current Protocols in Protein Science," Coligan, J. E. et al. (eds.) Volume 3, chapters 19 and 20, published by John Wiley & Sons Inc., and "Current Protocols in Immunology," Coligan, J. E. et al. (eds.) published by John Wiley & Sons Inc., and relevant references included therein.

Cytokine Release in Whole Blood: The interaction of mAb with human blood cells can be investigated by a cytokine release (Wing, M. G. (1995) Therapeut. Immunol. 2(4): 183-190; "Current Protocols in Pharmacology," Enna, S. J. et al. (eds.) published by John Wiley & Sons Inc; Madhusudan, S. (2004) Clin. Cancer Res. 10(19): 6528-6534; Cox, J. (2006) Methods 38(4): 274-282; Choi, I. (2001) Eur. J. Immunol. 31(1): 94-106). Briefly, various concentrations of mAb are incubated with human whole blood for 24 hours. The concentration tested should cover a wide range including final concentrations mimicking typical blood levels in patients (including but not limited to 100 ng/ml-100 µg/ml). Following the incubation, supernatants and cell lysates were analyzed for the presence of IL-1Rα, TNF-α, IL-1b, IL-6 and IL-8. Cytokine concentration profiles generated for mAb were compared to profiles produced by a negative human IgG control and a positive LPS or PHA control. The cytokine profile displayed by mAb from both cell supernatants and cell lysates was comparable to control human IgG. In an embodiment, the monoclonal antibody does not interact with human blood cells to spontaneously release inflammatory cytokines.

Cytokine release studies for a DVD-Ig are complex due to the four or more binding sites, two each for each antigen. Briefly, cytokine release studies as described herein measure the effect of the whole DVD-Ig molecule on whole blood or other cell systems, but can resolve which portion of the molecule causes cytokine release. Once cytokine release has been detected, the purity of the DVD-Ig preparation has to be ascertained, because some co-purifying cellular components can cause cytokine release on their own. If purity is not the issue, fragmentation of DVD-Ig (including but not limited to removal of Fc portion, separation of binding sites etc.), binding site mutagenesis or other methods may need to be employed to deconvolute any observations. It is readily apparent that this complex undertaking is greatly simplified if the two parental antibodies are selected for lack of cytokine release prior to being combined into a DVD-Ig.

B.13. Cross Reactivity to Other Species for Toxicological Studies

In an embodiment, the individual antibodies are selected with sufficient cross-reactivity to appropriate tox species, for example, cynomolgus monkey. Parental antibodies need to bind to orthologous species target (i.e., cynomolgus monkey) and elicit appropriate response (modulation, neutralization, activation). In an embodiment, the cross-reactivity (affinity/potency) to orthologous species target should be within 10-fold of the human target. In practice, the parental antibodies are evaluated for multiple species, including mouse, rat, dog, monkey (and other non-human primates), as well as disease model species (i.e., sheep for asthma model). The acceptable cross-reactivity to tox species from the perental monoclonal antibodies allows future toxicology studies of DVD-Ig-Ig in the same species. For that reason, the two parental monoclonal antibodies should have acceptable cross-reactivity for a common tox species, thereby allowing toxicology studies of DVD-Ig in the same species.

Parent mAbs may be selected from various mAbs that bind specific targets and are well known in the art. The parent antibodies can be the same antibody or different antibodies. These include, but are not limited to anti-TNF antibody (U.S. Pat. No. 6,258,562), anti-IL-12 and/or anti-IL-12p40 antibody (U.S. Pat. No. 6,914,128); anti-IL-18 antibody (U.S. Patent Publication No, 2005/0147610), anti-C5, anti-CBL, anti-CD147, anti-gp120, anti-VLA-4, anti-CD11a, anti-CD18, anti-VEGF, anti-CD40L, anti CD-40 (e.g., see PCT Publication No. WO 2007/124299) anti-Id, anti-1CAM-1, anti-CXCL13, anti-CD2, anti-EGFR, anti-TGF-beta 2, anti-HGF, anti-cMet, anti DLL-4, anti-NPR1, anti-PLGF, anti-ErbB3, anti-E-selectin, anti-Fact VII, anti-Her2/neu, anti-F gp, anti-CD11/18, anti-CD14, anti-ICAM-3, anti-RON, anti-SOST, anti CD-19, anti-CD80 (e.g., see PCT Publication No, WO 2003/039486, anti-CD4, anti-CD3, anti-CD23, anti-beta2-integrin, anti-alpha4beta7, anti-CD52, anti-HLA DR, anti-CD22 (e.g., see U.S. Pat. No. 5,789,554), anti-CD20, anti-MIF, anti-CD64 (FcR), anti-TCR alpha beta, anti-CD2, anti-Hep B, anti-CA 125, anti-EpCAM, anti-gp120, anti-CMV, anti-gpllblla anti-IgE, anti-CD25, anti-CD33, anti-HLA, anti-IGF1,2, anti IGFR, anti-VNRintegrin, anti-IL-1alpha, anti-IL-1beta, anti-IL-1 receptor, anti-IL-2 receptor, anti-IL-4, anti-IL-4 receptor, anti-IL5, anti-IL-5 receptor, anti-IL-6, anti-IL-8, anti-IL-9, anti-IL-13, anti-IL-13 receptor, anti-IL-17, anti-IL-6R, anti-RANKL, anti-NGF, anti-DKK, anti-alphaVbeta3, anti-IL-17A, anti-IL-23p19 and anti-IL-23 (see Presta, L. G. (2005) J. Allergy Clin. Immunol, 116: 731-6.

Parent mAbs may also be selected from various therapeutic antibodies approved for use, in clinical trials, or in development for clinical use. Such therapeutic antibodies include, but are not limited to, rituximab (Rituxan®, IDEC/Genentech/Roche) (see, for example, U.S. Pat. No. 5,736,137), a chimeric anti-CD20 antibody approved to treat Non-Hodgkin's lymphoma; HuMax-CD20, an anti-CD20 currently being developed by Genmab, an anti-CD20 antibody described in U.S. Pat. No. 5,500,362, AME-133 (Applied Molecular Evolution), hA20 (Immunomedics, Inc.), HumaLYM (Intracel), and PRO70769 (PCT Application No. PCT/US2003/040426), trastuzumab (Herceptin®, Genentech) (see, for example, U.S. Pat. No. 5,677,171), a humanized anti-Her2/neu antibody approved to treat breast cancer; pertuzumab (rhuMab-2C4, Omnitarg®), currently being developed by Genentech; an anti-Her2 antibody (U.S. Pat. No. 4,753,894; cetuximab (Erbitux®, Imclone) (U.S. Pat. No. 4,943,533; PCT Publication No. WO 96/40210), a chimeric anti-EGFR antibody in clinical trials for a variety of cancers; ABX-EGF (U.S. Pat. No. 6,235,883), currently being developed by Abgenix-Immunex-Amgen; HuMax-EGFr (U.S. Pat. No. 7,247,301), currently being developed by Genmab; 425, EMD55900, EMD62000, and EMD72000 (Merck KGaA) (U.S. Pat. No. 5,558,864; Murthy, et al. (1987) Arch. Biochem. Biophys. 252(2): 549-60; Rodeck, et al. (1987) J. Cell. Biochem. 35(4): 315-20; Kettleborough, et al. (1991) Protein Eng. 4(7): 773-83); ICR62 (Institute of Cancer Research) (PCT Publication No. WO 95/20045; Modjtahedi, et al. (1993) J. Cell. Biophys. 22(1-3): 129-46; Modjtahedi, et al. (1993) Br. J. Cancer 67(2): 247-53; Modjtahedi, et al. (1996) Br. J. Cancer 73(2): 228-35; Modjtahedi, et al. (2003) Int. J. Cancer 105(2): 273-80); TheraCIM hR3 (YM Biosciences, Canada and Centro de Immunologia Molecular, Cuba (U.S. Pat. No. 5,891,996; U.S. Pat. No. 6,506,883; Mateo, et al. (1997) Immunotechnol. 3(1): 71-81); mAb-806 (Ludwig Institute for Cancer Research, Memorial Sloan-Kettering) (Jungbluth, et al. (2003) Proc. Natl. Acad. Sci. USA. 100(2): 639-44); KSB-102 (KS Biomedix); MR1-1 (IVAX, National Cancer Institute) (PCT Publication No. WO 01/62931A2); and SC100 (Scancell) (PCT Publication No. WO 01/88138); alemtuzumab (Campath®, Millenium), a humanized mAb currently approved for treatment of B-cell chronic lymphocytic leukemia; muromonab-CD3 (Orthoclone OKT3®), an anti-CD3 antibody developed by Ortho Biotech/Johnson & Johnson, ibritumomab tiuxetan (Zevalin®), an anti-CD20 antibody developed by IDEC/Schering AG, gemtuzumab ozogamicin (Mylotarg®), an anti-CD33 (p67 protein) antibody developed by Celltech/Wyeth, alefacept (Amevive®), an anti-LFA-3 Fc fusion developed by Biogen), abciximab (ReoPro®), developed by Centocor/Lilly, basiliximab (Simulect®), developed by Novartis, palivizumab (Synagis®), developed by Medimmune, infliximab (Remicade®), an anti-TNFalpha antibody developed by Centocor, adalimumab (Humira®), an anti-TNFalpha antibody developed by Abbott, Humicade®, an anti-TNFalpha antibody developed by Celltech, golimumab (CNTO-148), a fully human TNF antibody developed by Centocor, etanercept (Enbrel®), an p75 TNF receptor Fc fusion developed by Immunex/Amgen, lenercept, an p55TNF receptor Fc fusion previously developed by Roche, ABX-CBL, an anti-CD147 antibody being developed by Abgenix, ABX-IL8, an anti-IL8 antibody being developed by Abgenix, ABX-MA1, an anti-MUC18 antibody being developed by Abgenix, Pemtumomab (R1549, 90Y-muHMFG1), an anti-MUC1 in development by Antisoma, Therex (R1550), an anti-MUC1 antibody being developed by Antisoma, AngioMab (AS1405), being developed by Antisoma, HuBC-1, being developed by Antisoma, Thioplatin (AS1407) being developed by Antisoma, Antegren® (natalizumab), an anti-alpha-4-beta-1 (VLA-4) and alpha-4-beta-7 antibody being developed by Biogen, VLA-1 mAb, an anti-VLA-1 integrin antibody being developed by Biogen, LTBR mAb, an anti-lymphotoxin beta receptor (LTBR) antibody being developed by Biogen, CAT- 152, an anti-TGF-β2 antibody being developed by Cambridge Antibody Technology, ABT 874 (J695), an anti-IL-12 p40 antibody being developed by Abbott, CAT-192, an anti-TGFβ1 antibody being developed by Cambridge Antibody Technology and Genzyme, CAT-213, an anti-Eotaxin1 antibody being developed by Cambridge Antibody Technology, LymphoStat-B® an anti-Blys antibody being developed by Cambridge Antibody Technology and Human Genome Sciences Inc., TRAIL-R1 mAb, an anti-TRAIL-R1 antibody being developed by Cambridge Antibody Technology and Human Genome Sciences, Inc., Avastin® bevacizumab, rhuMAb-VEGF), an anti-VEGF antibody being developed by Genentech, an anti-HER receptor family antibody being developed by Genentech, Anti-Tissue Factor (ATF), an anti-Tissue Factor antibody being developed by Genentech, Xolair® (Omalizumab), an anti-IgE antibody being developed by Genentech, Raptiva® (Efalizumab), an anti-CD11a antibody being developed by Genentech and Xoma, MLN-02 Antibody (formerly LDP-02), being developed by Genentech and Millenium Pharmaceuticals, HuMax CD4, an anti-CD4 antibody being developed by Genmab, HuMax-IL15, an anti-IL15 antibody being developed by Genmab and Amgen, HuMax-Inflam, being developed by Genmab and Medarex, HuMax-Cancer, an anti-Heparanase I antibody being developed by Genmab and Medarex and Oxford GcoSciences, HuMax-Lymphoma, being developed by Genmab and Amgen, HuMax-TAC, being developed by Genmab, IDEC-131, and anti-CD40L antibody being developed by IDEC Pharmaceuticals, IDEC-151 (Clenoliximab), an anti-CD4 antibody being developed by IDEC Pharmaceuticals, IDEC-114, an anti-CD80 antibody being developed by IDEC Pharmaceuticals, IDEC-152, an anti-CD23 being developed by IDEC Pharmaceuticals, anti-macrophage migration factor (MIF) antibodies being developed by IDEC Pharmaceuticals, BEC2, an anti-idiotypic antibody being developed by Imclone, IMC-1C11, an anti-KDR antibody being developed by Imclone, DC101, an anti-flk-1 antibody being developed by Imclone, anti-VE cadherin antibodies being developed by Imclone, CEA-Cide® (Iabetuzumab), an anti-carcinoembryonic antigen (CEA) antibody being developed by Immunomedics, LymphoCide® (Epratuzumab), an anti-CD22 antibody being developed by Immunomedics, AFP-Cide, being developed by Immunomedics, MyelomaCide, being developed by Immunomedics, LkoCide, being developed by Immunomedics, ProstaCide, being developed by Immunomedics, MDX-010, an anti-CTLA4 antibody being developed by Medarex, MDX-060, an anti-CD30 antibody being developed by Medarex, MDX-070 being developed by Medarex, MDX-018 being developed by Medarex, Osidem® (IDM-1), and anti-Her2 antibody being developed by Medarex and Immuno-Designed Molecules, HuMax®-CD4, an anti-CD4 antibody being developed by Medarex and Genmab, HuMax-IL15, an anti-IL15 antibody being developed by Medarex and Genmab, CNTO 148, an anti-TNFα antibody being developed by Medarex and Centocor/J&J, CNTO 1275, an anti-cytokine antibody being developed by Centocor/J&J, MOR101 and MOR102, anti-intercellular adhesion molecule-1 (ICAM-1) (CD54) antibodies being developed by MorphoSys, MOR201, an anti-fibroblast growth factor receptor 3 (FGFR-3) antibody being developed by MorphoSys, Nuvion® (visilizumab), an anti-CD3 antibody being developed by Protein Design Labs, HuZAF®, an anti-gamma interferon antibody being developed by Protein Design Labs, Anti-α 5β1 Integrin, being developed by Protein Design Labs, anti-IL-12, being developed by Protein Design Labs, ING-1, an anti-Ep-CAM antibody being developed by Xoma, Xolair® (Omalizumab) a humanized anti-IgE antibody developed by Genentech and Novartis, and MLN01, an anti-Beta2 integrin antibody being developed by Xoma. In another embodiment, the therapeutics include KRN330 (Kirin); huA33 antibody (A33, Ludwig Institute for Cancer Research); CNTO 95 (alpha V integrins, Centocor); MEDI-522 (alpha Vβ3 integrin, Medimmune); volociximab (alpha Vβ1 integrin, Biogen/PDL); Human mAb 216 (B cell glycosolated epitope, NCI); BiTE MT103 (bispecific CD19×CD3, Medimmune); 4G7×H22 (Bispecific BcellxFcgammaR1, Medarex/Merck KGa); rM28 (Bispecific CD28×MAPG, EP Patent No. EP1444268); MDX447 (EMD 82633) (Bispecific CD64× EGFR, Medarex); Catumaxomab (removab) (Bispecific EpCAM×anti-CD3, Trion/Fres); Ertumaxomab (bispecific HER2/CD3, Fresenius Biotech); oregovomab (OvaRex) (CA-125, ViRexx); Rencarex® (WX G250) (carbonic anhydrase IX, Wilex); CNTO 888 (CCL2, Centocor); TRC105 (CD105 (endoglin), Tracon); BMS-663513 (CD137 agonist, Brystol Myers Squibb); MDX-1342 (CD19, Medarex); Siplizumab (MEDI-507) (CD2, Medimmune); Ofatumumab (Humax-CD20) (CD20, Genmab); Rituximab (Rituxan) (CD20, Genentech); veltuzumab (hA20) (CD20, Immunomedics); Epratuzumab (CD22, Amgen); lumiliximab (IDEC 152) (CD23, Biogen); muromonab-CD3 (CD3, Ortho); HuM291 (CD3 fc receptor, PDL Biopharma); HeFi-1, CD30, NCl); MDX-060 (CD30, Medarex); MDX-1401 (CD30, Medarex); SGN-30 (CD30, Seattle Genentics); SGN-33 (Lintuzumab) (CD33, Seattle Genentics); Zanolimumab (HuMax-CD4) (CD4, Genmab); HCD122 (CD40, Novartis); SGN-40 (CD40, Seattle Genentics); Campathlh (Alemtuzumab) (CD52, Genzyme); MDX-1411 (CD70, Medarex); hLL1 (EPB-1) (CD74.38, Immunomedics); Galiximab (IDEC-144) (CD80, Biogen); MT293 (TRC093/D93) (cleaved collagen, Tracon); HuLuc63 (CS1, PDL Pharma); ipilimumab (MDX-010) (CTLA4, Brystol Myers Squibb); Tremelimumab (Ticilimumab, CP-675,2) (CTLA4, Pfizer); HGS-ETR1 (Mapatumumab) (DR4 TRAIL-R1 agonist, Human Genome Science/Glaxo Smith Kline); AMG-655 (DR5, Amgen); Apomab (DR5, Genentech); CS-1008 (DR5, Daiichi Sankyo); HGS-ETR2 (lexatumumab) (DR5 TRAIL-R2 agonist, HGS); Cetuximab (Erbitux) (EGFR, Imclone); IMC-11F8, (EGFR, Imclone); Nimotuzumab (EGFR, YM Bio); Panitumumab (Vectabix) (EGFR, Amgen); Zalutumumab (HuMaxEGFr) (EGFR, Genmab); CDX-110 (EGFRvIII, AVANT Immunotherapeutics); adecatumumab (MT201) (Epcam™, Merck); edrecolomab (Panorex, 17-1A) (Epcam™, Glaxo/Centocor); MORAb-003 (folate receptor a, Morphotech); KW-2871 (ganglioside GD3, Kyowa); MORAb-009 (GP-9, Morphotech); CDX-1307 (MDX-1307) (hCGb, Celldex); Trastuzumab (Herceptin) (HER2, Celldex); Pertuzumab (rhuMAb 2C4) (HER2 (DI), Genentech); apolizumab (HLA-DR beta chain, PDL Pharma); AMG-479 (IGF-1R, Amgen); anti-IGF-1R R1507 (IGF1-R, Roche); CP 751871 (IGF-1R, Pfizer); IMC-A12 (IGF1-R, Imclone); BIIB022 (IGF-1R, Biogen); Mik-beta-1 (IL-2Rb (CD122), Hoffman LaRoche); CNTO 328 (IL6, Centocor); Anti-KIR (1-7F9) (Killer cell Ig-like Receptor (KIR), Novo); Hu3S193 (Lewis (y), Wyeth, Ludwig Institute of Cancer Research); hCBE-11 (LTβR, Biogen); HuHMFG1 (MUC1, Antisoma/NCI); RAV12 (N-linked carbohydrate epitope, Raven); CAL (parathyroid hormone-related protein (PTH-rP), University of California); CT-011 (PD1, CureTech); MDX-1106 (ono-4538) (PD1, Medarex/Ono); MAb CT-011 (PD1, Curetech); IMC-3G3 (PDGFRa, Imclone); bavituximab (phosphatidylserine, Peregrine); huJ591 (PSMA, Cornell Research Foundation); muJ591 (PSMA, Cornell Research Foundation); GC1008 (TGFb (pan) inhibitor (IgG4), Genzyme); Infliximab (Remicade) (TNFα, Centocor); A27.15 (transferrin receptor, Salk Institute, INSERN WO 2005/111082); E2.3 (transferrin receptor, Salk Institute); Bevacizumab (Avastin) (VEGF, Genentech); HuMV833 (VEGF, Tsukuba Research Lab, PCT Publication No. WO/2000/034337, University of Texas); IMC-18F1 (VEGFR1, Imclone); IMC-1121 (VEGFR2, Imclone).

C. Construction of DVD Molecules

The dual variable domain immunoglobulin (DVD-Ig) molecule is designed such that two different light chain variable domains (VL) from the two parent monoclonal antibodies, which can be the same or different, are linked in tandem directly or via a short linker by recombinant DNA techniques, followed by the light chain constant domain, and optionally, an Fc region. Similarly, the heavy chain comprises two different heavy chain variable domains (VH) linked in tandem, followed by the constant domain CH1 and Fc region (FIG. 1A).

The variable domains can be obtained using recombinant DNA techniques from a parent antibody generated by any one of the methods described herein. In an embodiment, the variable domain is a murine heavy or light chain variable domain. In another embodiment, the variable domain is a CDR grafted or a humanized variable heavy or light chain domain. In an embodiment, the variable domain is a human heavy or light chain variable domain.

In one embodiment the first and second variable domains are linked directly to each other using recombinant DNA techniques. In another embodiment the variable domains are linked via a linker sequence. In an embodiment, two variable domains are linked. Three or more variable domains may also be linked directly or via a linker sequence. The variable domains may bind the same antigen or may bind different antigens. DVD-Ig molecules provided herein may include one immunoglobulin variable domain and one non-immunoglobulin variable domain, such as ligand binding domain of a receptor, or an active domain of an enzyme. DVD-Ig molecules may also comprise two or more non-Ig domains.

The linker sequence may be a single amino acid or a polypeptide sequence. In an embodiment, the linker sequence is AKTTPKLEEGEFSEAR (SEQ ID NO: 1); AKTTPKLEEGEFSEARV (SEQ ID NO: 2); AKTTPKLGG (SEQ ID NO: 3); SAKTTPKLGG (SEQ ID NO: 4); SAKTTP (SEQ ID NO: 5); RADAAP (SEQ ID NO: 6); RADAAPTVS (SEQ ID NO: 7); RADAAAAGGPGS (SEQ ID NO: 8); RADAAAA(G₄S)₄ (SEQ ID NO: 9); SAKTTPKLEEGEFSEARV (SEQ ID NO: 10); ADAAP (SEQ ID NO: 11); ADAAPTVSIFPP (SEQ ID NO: 12); TVAAP (SEQ ID NO: 13); TVAAPSVFIFPP (SEQ ID NO: 14); QPKAAP (SEQ ID NO: 15); QPKAAPSVTLFPP (SEQ ID NO: 16); AKTTPP (SEQ ID NO: 17); AKTTPPSVTPLAP (SEQ ID NO: 18); AKTTAP (SEQ ID NO: 19); AKTTAPSVYPLAP (SEQ ID NO: 20); ASTKGP (SEQ ID NO: 21); ASTKGPSVFPLAP (SEQ ID NO: 22), GGGGSGGGGSGGGGS (SEQ ID NO: 23); GENKVEYAPALMALS (SEQ ID NO: 24); GPAKELTPLKEAKVS (SEQ ID NO: 25); or GHEAAAVMQVQYPAS (SEQ ID NO: 26). The choice of linker sequences is based on crystal structure analysis of several Fab molecules. There is a natural flexible linkage between the variable domain and the CH1/CL constant domain in Fab or antibody molecular structure. This natural linkage comprises approximately 10-12 amino acid residues, contributed by 4-6 residues from C-terminus of V domain and 4-6 residues from the N-terminus of CL/CH1 domain. DVD Igs provided herein were generated using N-terminal 5-6 amino acid residues, or 11-12 amino acid residues, of CL or CH1 as linker in light chain and heavy chain of DVD-Ig, respectively. The N-terminal residues of the CL or CH1 domain, particularly the first 5-6 amino acid residues, adopt a loop conformation without strong secondary structure, and, therefore, can act as a flexible linker between the two variable domains. The N-terminal residues of the CL or CH1 domain are a natural extension of the variable domains, as they are part of the Ig sequences, and, therefore, minimize to a large extent any immunogenicity potentially arising from the linkers and junctions.

Other linker sequences may include any sequence of any length of the CL/CH1 domain but not all residues of the CL/CH1 domain (for example, the first 5-12 amino acid residues of the CL/CH1 domains) the light chain linkers can be from Cκ or Cλ; and the heavy chain linkers can be derived from CH1 of any isotypes, including Cγ1, Cγ2, Cγ3, Cγ4, Cα1, Cα2, Cδ, Cε, and Cμ. Linker sequences may also be derived from other proteins such as Ig-like proteins, (e.g. TCR, FcR, KIR); G/S based sequences (e.g., G4S repeats) (SEQ ID NO:29); hinge region-derived sequences; and other natural sequences from other proteins.

In an embodiment a constant domain is linked to the two linked variable domains using recombinant DNA techniques. In an embodiment, sequence comprising linked heavy chain variable domains is linked to a heavy chain constant domain and sequence comprising linked light chain variable domains is linked to a light chain constant domain. In an embodiment, the constant domains are human heavy chain constant domain and human light chain constant domain respectively. In an embodiment, the DVD heavy chain is further linked to an Fc region. The Fc region may be a native sequence Fc region, or a variant Fc region. In another embodiment, the Fc region is a human Fc region. In another embodiment the Fc region includes Fc region from IgG1, IgG2, IgG3, IgG4, IgA, IgM, IgE, or IgD.

In another embodiment two heavy chain DVD polypeptides and two light chain DVD polypeptides are combined to form a DVD-Ig molecule. Table 2 lists amino acid sequences of VH and VL regions of exemplary antibodies for targets useful for treating disease, e.g., for treating cancer. A DVD comprising at least two of the VH and/or VL regions listed in Table 2, in any orientation is provided. In some embodiments, VD1 and VD2 are independently chosen. Therefore, in some embodiments, VD1 and VD2 comprise the same SEQ ID NO and, in other embodiments, VD1 and VD2 comprise different SEQ ID NOS.

The VH and VL domain sequences provided below comprise complementary determining region (CDR) and framework sequences that are either known in the art or readily discernable using methods known in the art. In some embodiments, one or more of these CDR and/or framework sequences are replaced, without loss of function, by other CDR and/or framework sequences from binding proteins that are known in the art to bind to the same antigen.

TABLE 2

List of Amino Acid Sequences of VH and VL
regions of Antibodies for Generating DVD-Igs

| SEQ ID No. | ABT Unique ID | Protein region | Sequence 1234567890123456789012345678901234567890 |
|---|---|---|---|
| 30 | AB268VH | VH-IL1β (seq. 1) | EVQLVESGGGVVQPGRSLRLSCSASGFIFSRYD MSWVRQAPGKGLEWVAYISHGGAGTYYPDSVKG RFTISRDNSKNTLFLQMDSLRPEDTGVYFCARG GVTKGYFDVWGQGTPVTVSS |
| 31 | AB268VL | VL-IL1 β (seq. 1) | DIQMTQSPSSLSASVGDRVTITCRASGNIHNYL TWYQQTPGKAPKLLIYNAKTLADGVPSRFSGSG SGTDYTFTISSLQPEDIATYYCQHFWSIPYTFG QGTKLQITR |
| 32 | AB269VH | VH-IL1 β (seq. 2) | EVQLVESGGGVVQPGRSLRLSCSASGFIFSRYD MSWVRQAPGKGLEWVAYISHGGAGTYYPDSVKG RFTISRDNSKNTLFLQMDSLRAEDTAVYYCARG GVYKGYFDVWGQGTPVTVSS |
| 33 | AB269VL | VL-IL1 β (seq. 2) | DIQMTQSPSSLSASVGDRVTITCRASGNIHNYL TWYQQTPGKAPKLLIYNAKTLADGVPSRFSGSG SGTDYTFTISSLQPEDIATYYCQHFWSIPYTFG QGTKLQITR |
| 34 | AB270VH | VH-IL1 β (seq. 3) | EVQLQESGPGLVKPSETLSLTCTVSGFSLSDYG VSWIRQPPGKGLEWLGLIWGGGDTYYNSPLKSR LTISKDNSKSQVSLKLSSVTAADTAVYYCAKQR TLWGYDLYGMDYWGQGTLVTVSS |
| 35 | AB270VL | VL-IL β (seq. 3) | DTQVTQSPSSLSASVGDRVTITCITSTDIDVDM NWYQQKPGKPPKLLISQGNTLRPGVPSRFSSSG SGTDFTFTISSLQPEDFATYYCLQSDNLPLTFG QGTKLEIKR |
| 36 | AB271VH | VH-IL1 β (seq. 4) | EVQLQESGPGLVKPSETLSLTCTVSGFSLSDYG VSWIRQPPGKGLEWLGLIWGGGDTYYNSPLKSR LTISKDNSKSQVSLKLSSVTAADTAVYYCAKQR TLWGYDLYGMDYWGQGTLVTVSS |
| 37 | AB271VL | VL-IL1 β (seq. 4) | DTVVTQSPAFLSVTPGEKVTITCITSTDIDVDM NWYQQKPDQPPKLLISQGNTLRPGVPSRFSSSG SGTDFTFTISSLEAEDAATYYCLQSDNLPLTFG QGTKLEIKR |
| 38 | AB272VH | VH-IL1 β (seq. 5) | EVQLVESGGGLVQPGGSLRLSCAVSGFTLSDYG VSWIRQAPGKGLEWLGLIWGGGDTYYNSPLKSR LTISKDNSKSTVYLQMNSLRAEDTAVYYCAKQR TLWGYDLYGMDYWGQGTLVTVSS |
| 39 | AB272VL | VL-IL1 β (seq. 5) | ETTVTQSPSSLSASVGDRVTITCITSTDIDVDM NWYQQKPGKPPKLLISQGNTLRPGVPSRFSSSG SGTDFTFTISSLQPEDFATYYCLQSDNLPLTFG QGTKLEIKR |
| 40 | AB273VH | VH-IL17 (seq. 1) | EVQLVQSGAEVKKPGSSVKVSCKASGYTFTDYE IHWVRQAPGQGLEWMGVNDPESGGTFYNQKFDG RVTLTADESTSTAYMELSSLRSEDTAVYYCTRY SKWDSFDGMDYWGQGTTVTVSS |
| 41 | AB273VL | VL-IL17 (seq. 1) | DIQMTQSPSSLSASVGDRVTITCRASSGIISYI DWFQQKPGKAPKRLIYATFDLASGVPSRFSGSG SGTDYTLTISSLQPEDFATYYCRQVGSYPETFG QGTKLEIKR |
| 42 | AB274VH | VH-IL17 (seq. 2) | EVQLVQSGAEVKKPGSSVKVSCKASGGSFGGYG IGWVRQAPGQGLEWMGGITPFFGFADYAQKFQG RVTITADESTTTAYMELSGLTSDDTAVYYCARD PNEFWNGYYSTHDFDSWGQGTTVTVSS |
| 43 | AB274VL | VL-IL17 (seq. 2) | EIVLTQSPDFQSVTPKEKVTITCRASQDIGSEL HWYQQKPDQPPKLLIKYASHSTSGVPSRFSGSG SGTDFTLTINGLEAEDAGTYYCHQTDSLPYTFG PGTKVDIKR |

TABLE 2-continued

List of Amino Acid Sequences of VH and VL
regions of Antibodies for Generating DVD-Igs

| SEQ ID No. | ABT Unique ID | Protein region | Sequence 123456789012345678901234567890123 4567890 |
|---|---|---|---|
| 44 | AB275VH | VH-IL17 (seq. 3) | EVQLVQSGAEVKKPGESVKISCKASGGSFRSYG ISWVRQAPGQGLEWMGGITHFFGITDYAQKFQG RVTITADESTTTAYMELSGLTSDDTAVYYCARE PNDFWNGYYDTHDFDSWGQGTTVTVSS |
| 45 | AB275VL | VL-IL17 (seq. 3) | EIVLTQSPDFQSVTPKEKVTITCRASQNIGSEL HWYQQKPDQSPKLLIKYASHSISGVPSRFSGSG SGTDFTLTINGLEAEDAATYYCHQSDTLPHTFG QGTKVDIKR |

Detailed description of specific DVD-Ig molecules capable of binding specific targets, and methods of making the same, is provided in the Examples section below.

D. Production of DVD Proteins

Binding proteins provided herein may be produced by any of a number of techniques known in the art. For example, expression from host cells, wherein expression vector(s) encoding the DVD heavy and DVD light chains is (are) transfected into a host cell by standard techniques. The various forms of the term "transfection" are intended to encompass a wide variety of techniques commonly used for the introduction of exogenous DNA into a prokaryotic or eukaryotic host cell, e.g., electroporation, calcium-phosphate precipitation, DEAE-dextran transfection and the like. Although it is possible to express the DVD proteins in either prokaryotic or eukaryotic host cells, DVD proteins are expressed in eukaryotic cells, for example, mammalian host cells, because such eukaryotic cells (and in particular mammalian cells) are more likely than prokaryotic cells to assemble and secrete a properly folded and immunologically active DVD protein.

Exemplary mammalian host cells for expressing recombinant antibodies include Chinese Hamster Ovary (CHO cells) (including dhfr-CHO cells, described in Urlaub and Chasin, (1980) Proc. Natl. Acad. Sci. USA 77:4216-4220, used with a DHFR selectable marker, e.g., as described in Kaufman, R. J. and Sharp, P. A. (1982) Mol. Biol. 159:601-621), NS0 myeloma cells, COS cells, SP2 and PER.C6 cells. When recombinant expression vectors encoding DVD proteins are introduced into mammalian host cells, the DVD proteins are produced by culturing the host cells for a period of time sufficient to allow for expression of the DVD proteins in the host cells or secretion of the DVD proteins into the culture medium in which the host cells are grown. DVD proteins can be recovered from the culture medium using standard protein purification methods.

In an exemplary system for recombinant expression of DVD proteins, a recombinant expression vector encoding both the DVD heavy chain and the DVD light chain is introduced into dhfr-CHO cells by calcium phosphate-mediated transfection. Within the recombinant expression vector, the DVD heavy and light chain genes are each operatively linked to CMV enhancer/AdMLP promoter regulatory elements to drive high levels of transcription of the genes. The recombinant expression vector also carries a DHFR gene, which allows for selection of CHO cells that have been transfected with the vector using methotrexate selection/amplification. The selected transformant host cells are cultured to allow for expression of the DVD heavy and light chains and intact DVD protein is recovered from the culture medium. Standard molecular biology techniques are used to prepare the recombinant expression vector, transfect the host cells, select for transformants, culture the host cells and recover the DVD protein from the culture medium. A method of synthesizing a DVD protein provided herein by culturing a host cell in a suitable culture medium until a DVD protein is synthesized is provided. The method can further comprise isolating the DVD protein from the culture medium.

An important feature of DVD-Ig is that it can be produced and purified in a similar way as a conventional antibody. The production of DVD-Ig results in a homogeneous, single major product with desired dual-specific activity, without any sequence modification of the constant region or chemical modifications of any kind. Other previously described methods to generate "bi-specific," "multi-specific," and "multi-specific multivalent" full length binding proteins do not lead to a single primary product but instead lead to the intracellular or secreted production of a mixture of assembled inactive, mono-specific, multi-specific, multivalent, full length binding proteins, and multivalent full length binding proteins with combination of different binding sites. As an example, based on the design described by Miller and Presta (PCT Publication No. WO2001/077342(A1), there are 16 possible combinations of heavy and light chains. Consequently, only 6.25% of protein is likely to be in the desired active form, and not as a single major product or single primary product compared to the other 15 possible combinations. Separation of the desired, fully active forms of the protein from inactive and partially active forms of the protein using standard chromatography techniques, typically used in large scale manufacturing, is yet to be demonstrated.

Surprisingly, the design of the "dual-specific multivalent full length binding proteins" provided herein leads to a dual variable domain light chain and a dual variable domain heavy chain which assemble primarily to the desired "dual-specific multivalent full length binding proteins".

At least 50%, at least 75% and at least 90% of the assembled, and expressed dual variable domain immunoglobulin molecules are the desired dual-specific tetravalent protein. This aspect particularly enhances commercial utility. Therefore, a method to express a dual variable domain light chain and a dual variable domain heavy chain in a single cell leading to a single primary product of a "dual-specific tetravalent full length binding protein" is provided.

Methods of expressing a dual variable domain light chain and a dual variable domain heavy chain in a single cell leading to a "primary product" of a "dual-specific tetravalent full length binding protein," where the "primary product" is more than 50% of all assembled protein, comprising a dual variable domain light chain and a dual variable domain heavy chain are provided.

Methods of expressing a dual variable domain light chain and a dual variable domain heavy chain in a single cell leading to a single "primary product" of a "dual-specific tetravalent full length binding protein," where the "primary product" is more than 75% of all assembled protein, comprising a dual variable domain light chain and a dual variable domain heavy chain are provided.

Methods of expressing a dual variable domain light chain and a dual variable domain heavy chain in a single cell leading to a single "primary product" of a "dual-specific tetravalent full length binding protein," where the "primary product" is more than 90% of all assembled protein, comprising a dual variable domain light chain and a dual variable domain heavy chain are provided.

II. Derivatized DVD Binding Proteins

One embodiment provides a labeled binding protein wherein the binding protein is derivatized or linked to another functional molecule (e.g., another peptide or protein). For example, a labeled binding protein can be derived by functionally linking the binding protein (by chemical coupling, genetic fusion, noncovalent association or otherwise) to one or more other molecular entities, such as another antibody (e.g., a bispecific antibody or a diabody), a detectable agent, a cytotoxic agent, a pharmaceutical agent, and/or a protein or peptide that can mediate association of the binding protein with another molecule (such as a streptavidin core region or a polyhistidine tag).

Useful detectable agents with which the binding protein may be derivatized include fluorescent compounds. Exemplary fluorescent detectable agents include fluorescein, fluorescein isothiocyanate, rhodamine, 5-dimethylamine-1-napthalenesulfonyl chloride, phycoerythrin and the like. A binding protein may also be derivatized with detectable enzymes, such as alkaline phosphatase, horseradish peroxidase, glucose oxidase and the like. When a binding protein is derivatized with a detectable enzyme, it is detected by adding additional reagents that the enzyme uses to produce a detectable reaction product. For example, when the detectable agent horseradish peroxidase is present, the addition of hydrogen peroxide and diaminobenzidine leads to a colored reaction product, which is detectable. A binding protein may also be derivatized with biotin, and detected through indirect measurement of avidin or streptavidin binding.

A crystallized binding protein and formulations and compositions comprising such crystals are provided. In one embodiment the crystallized binding protein has a greater half-life in vivo than the soluble counterpart of the binding protein. In another embodiment the binding protein retains biological activity after crystallization.

Crystallized binding protein may be produced according to methods known in the art and as disclosed in PCT Publication No. WO 02/072636.

A glycosylated binding protein wherein the antibody or antigen-binding portion thereof comprises one or more carbohydrate residues is provided. Nascent in vivo protein production may undergo further processing, known as post-translational modification. In particular, sugar (glycosyl) residues may be added enzymatically, a process known as glycosylation. The resulting proteins bearing covalently linked oligosaccharide side chains are known as glycosylated proteins or glycoproteins. Antibodies are glycoproteins with one or more carbohydrate residues in the Fc domain, as well as the variable domain. Carbohydrate residues in the Fc domain have an important effect on the effector function of the Fc domain, with minimal effect on antigen binding or half-life of the antibody (Jefferis, R. (2005) Biotechnol. Prog. 21: 11-16). In contrast, glycosylation of the variable domain may have an effect on the antigen binding activity of the antibody. Glycosylation in the variable domain may have a negative effect on antibody binding affinity, likely due to steric hindrance (Co, M. S., et al. (1993) Mol. Immunol. 30:1361-1367), or result in increased affinity for the antigen (Wallick, S. C., et al. (1988) Exp. Med. 168:1099-1109; Wright, A., et al. (1991) EMBO J. 10:2717-2723).

One embodiment is directed to generating glycosylation site mutants in which the O- or N-linked glycosylation site of the binding protein has been mutated. One skilled in the art can generate such mutants using standard well-known technologies. Glycosylation site mutants that retain the biological activity but have increased or decreased binding activity are also provided.

In still another embodiment, the glycosylation of the antibody or antigen-binding portion is modified. For example, an aglycoslated antibody can be made (i.e., the antibody lacks glycosylation). Glycosylation can be altered to, for example, increase the affinity of the antibody for antigen. Such carbohydrate modifications can be accomplished by, for example, altering one or more sites of glycosylation within the antibody sequence. For example, one or more amino acid substitutions can be made that result in elimination of one or more variable region glycosylation sites to thereby eliminate glycosylation at that site. Such aglycosylation may increase the affinity of the antibody for antigen. Such an approach is described in further detail in PCT Publication WO 2003/016466A2, and U.S. Pat. Nos. 5,714,350 and 6,350,861.

Additionally or alternatively, a modified binding protein can be made that has an altered type of glycosylation, such as a hypofucosylated antibody having reduced amounts of fucosyl residues (see Kanda, Y. et al. (2007) J. Biotech. 130(3): 300-310.) or an antibody having increased bisecting GlcNAc structures. Such altered glycosylation patterns have been demonstrated to increase the ADCC ability of antibodies. Such carbohydrate modifications can be accomplished by, for example, expressing the antibody in a host cell with altered glycosylation machinery. Cells with altered glycosylation machinery have been described in the art and can be used as host cells in which to express recombinant antibodies to thereby produce an antibody with altered glycosylation. See, for example, Shields, R. L. et al. (2002) J. Biol. Chem. 277:26733-26740; Umana et al. (1999) Nat. Biotech. 17:176-1, as well as, European Patent No. EP 1,176,195 and PCT Publication Nos. WO 03/035835 and WO 99/54342 80.

Protein glycosylation depends on the amino acid sequence of the protein of interest, as well as the host cell in which the protein is expressed. Different organisms may produce different glycosylation enzymes (e.g., glycosyltransferases and glycosidases), and have different substrates (nucleotide sugars) available. Due to such factors, protein glycosylation pattern, and composition of glycosyl residues, may differ depending on the host system in which the particular protein is expressed. Glycosyl residues may include, but are not limited to, glucose, galactose, mannose, fucose, n-acetylglucosamine and sialic acid. In an embodiment, the glycosylated binding protein comprises glycosyl residues such that the glycosylation pattern is human.

It is known to those skilled in the art that differing protein glycosylation may result in differing protein characteristics. For instance, the efficacy of a therapeutic protein produced in a microorganism host, such as yeast, and glycosylated utilizing the yeast endogenous pathway may be reduced compared to that of the same protein expressed in a mammalian cell, such as a CHO cell line. Such glycoproteins may also be immunogenic in humans and show reduced half-life in vivo after administration. Specific receptors in humans and other animals may recognize specific glycosyl residues and promote the rapid clearance of the protein from the bloodstream. Other adverse effects may include changes in protein folding, solubility, susceptibility to proteases, trafficking, transport, compartmentalization, secretion, recognition by other proteins or factors, antigenicity, or allergenicity. Accordingly, a practitioner may choose a therapeutic protein with a specific composition and pattern of glycosylation, for example glycosylation composition and pattern identical, or at least similar, to that produced in human cells or in the species-specific cells of the intended subject animal.

Expressing glycosylated proteins different from that of a host cell may be achieved by genetically modifying the host cell to express heterologous glycosylation enzymes. Using techniques known in the art a practitioner may generate antibodies or antigen-binding portions thereof exhibiting human protein glycosylation. For example, yeast strains have been genetically modified to express non-naturally occurring glycosylation enzymes such that glycosylated proteins (glycoproteins) produced in these yeast strains exhibit protein glycosylation identical to that of animal cells, especially human cells (U.S. Pat. Nos. 7,449,308 and 7,029,872 and PCT Publication No/WO2005/100584).

In addition to binding proteins, other embodiments are also directed to anti-idiotypic (anti-Id) antibodies specific for such binding proteins. An anti-Id antibody is an antibody, which recognizes unique determinants generally associated with the antigen-binding region of another antibody. The anti-Id can be prepared by immunizing an animal with the binding protein or a CDR containing region thereof. The immunized animal will recognize, and respond to the idiotypic determinants of the immunizing antibody and produce an anti-Id antibody. It is readily apparent that it may be easier to generate anti-idiotypic antibodies to the two or more parent antibodies incorporated into a DVD-Ig molecule; and confirm binding studies by methods well recognized in the art (e.g., BIAcore, ELISA) to verify that anti-idiotypic antibodies specific for the idiotype of each parent antibody also recognize the idiotype (e.g., antigen binding site) in the context of the DVD-Ig. The anti-idiotypic antibodies specific for each of the two or more antigen binding sites of a DVD-Ig provide ideal reagents to measure DVD-Ig concentrations of a human DVD-Ig in patient serum; DVD-Ig concentration assays can be established using a "sandwich assay ELISA format" with an antibody to a first antigen binding region coated on the solid phase (e.g., BIAcore chip, ELISA plate etc.), rinsing with rinsing buffer, incubating with the serum sample, rinsing again and ultimately incubating with another anti-idiotypic antibody to the another antigen binding site, itself labeled with an enzyme for quantitation of the binding reaction. In an embodiment, for a DVD-Ig with more than two different binding sites, anti-idiotypic antibodies to the two outermost binding sites (most distal and proximal from the constant region) will not only help in determining the DVD-Ig concentration in human serum but also document the integrity of the molecule in vivo. Each anti-Id antibody may also be used as an "immunogen" to induce an immune response in yet another animal, producing a so-called anti-anti-Id antibody.

Further, it will be appreciated by one skilled in the art that a protein of interest may be expressed using a library of host cells genetically engineered to express various glycosylation enzymes, such that member host cells of the library produce the protein of interest with variant glycosylation patterns. A practitioner may then select and isolate the protein of interest with particular novel glycosylation patterns. In an embodiment, the protein having a particularly selected novel glycosylation pattern exhibits improved or altered biological properties.

III. Uses of DVD-Ig

Given their ability to bind to two or more antigens the binding proteins provided herein can be used to detect the antigens (e.g., in a biological sample, such as serum or plasma), using a conventional immunoassay, such as an enzyme linked immunosorbent assays (ELISA), a radioimmunoassay (RIA) or tissue immunohistochemistry. The DVD-Ig is directly or indirectly labeled with a detectable substance to facilitate detection of the bound or unbound antibody. Suitable detectable substances include various enzymes, prosthetic groups, fluorescent materials, luminescent materials and radioactive materials. Examples of suitable enzymes include horseradish peroxidase, alkaline phosphatase, β-galactosidase, and acetylcholinesterase; examples of suitable prosthetic group complexes include streptavidin/biotin and avidin/biotin; examples of suitable fluorescent materials include umbelliferone, fluorescein, fluorescein isothiocyanate, rhodamine, dichlorotriazinylamine fluorescein, dansyl chloride and phycoerythrin; an example of a luminescent material includes luminol; and examples of suitable radioactive material include $^{3}$H, $^{14}$C, $^{35}$S, $^{90}$Y, $^{99}$Tc, $^{111}$In, $^{125}$I, $^{131}$I, $^{177}$Lu, $^{166}$Ho, and $^{153}$Sm.

In an embodiment, the binding proteins neutralize the activity of the antigens both in vitro and in vivo. Accordingly, such DVD-Igs can be used to inhibit antigen activity, e.g., in a cell culture containing the antigens, in human subjects or in other mammalian subjects having antigens with which the binding protein cross-reacts. In another embodiment, a method for reducing antigen activity in a subject suffering from a disease or disorder in which the antigen activity is detrimental is provided. In some embodiments, the binding protein is administered to a human subject for therapeutic purposes.

As used herein, the term "a disorder in which antigen activity is detrimental" is intended to include diseases and other disorders in which the presence of the antigen in a subject suffering from the disorder has been shown to be or is suspected of being either responsible for the pathophysiology of the disorder or a factor that contributes to a worsening of the disorder. Accordingly, a disorder in which antigen activity is detrimental is a disorder in which reduction of antigen activity is expected to alleviate the symptoms and/or progression of the disorder. Such disorders may be evidenced, for example, by an increase in the concentration of the antigen in a biological fluid of a subject suffering from the disorder (e.g., an increase in the concentration of antigen in serum, plasma, synovial fluid, etc. of the subject). Non-limiting examples of disorders that can be treated include those disorders discussed below and in the section pertaining to pharmaceutical compositions.

DVD-Igs are useful as therapeutic agents to simultaneously block two different targets to enhance efficacy/safety and/or increase patient coverage. Such targets may include soluble targets (e.g., TNF) and cell surface receptor targets (e.g., VEGFR and EGFR). It can also be used to induce redirected cytotoxicity between tumor cells and T cells (e.g., Her2 and CD3) for cancer therapy, or between autoreactive cell and effector cells for autoimmune disease or transplantation, or between any target cell and effector cell to eliminate disease-causing cells in any given disease.

In addition, DVD-Ig can be used to trigger receptor clustering and activation when it is designed to target two different epitopes on the same receptor. This may have benefit in making agonistic and antagonistic anti-GPCR therapeutics. In this case, DVD-Ig can be used to target two different epitopes (including epitopes on both the loop regions and the extracellular domain) on one cell for clustering/signaling (two cell surface molecules) or signaling (on one molecule). Similarly, a DVD-Ig molecule can be designed to trigger CTLA-4 ligation, and a negative signal by targeting two different epitopes (or 2 copies of the same epitope) of CTLA-4 extracellular domain, leading to down regulation of the immune response. CTLA-4 is a clinically validated target for therapeutic treatment of a number of immunological disorders. CTLA-4/B7 interactions negatively regulate T cell activation by attenuating cell cycle progression, IL-2 production, and proliferation of T cells following activation, and CTLA-4 (CD152) engagement can down-regulate T cell activation and promote the induction of immune tolerance. However, the strategy of attenuating T cell activation by agonistic antibody engagement of CTLA-4 has been unsuccessful since CTLA-4 activation requires ligation. The molecular interaction of CTLA-4/B7 is in "skewed zipper" arrays, as demonstrated by crystal structural analysis (Stamper (2001) Nature 410: 608). However none of the currently available CTLA-4 binding reagents have ligation properties, including anti-CTLA-4 mAbs. There have been several attempts to address this issue. In one case, a cell member-bound single chain antibody was generated, and significantly inhibited allogeneic rejection in mice (Hwang (2002) J. Immunol. 169:633). In a separate case, artificial APC surface-linked single-chain antibody to CTLA-4 was generated and demonstrated to attenuate T cell responses (Griffin (2000) J. Immunol. 164:4433). In both cases, CTLA-4 ligation was achieved by closely localized member-bound antibodies in artificial systems. While these experiments provide proof-of-concept for immune down-regulation by triggering CTLA-4 negative signaling, the reagents used in these reports are not suitable for therapeutic use. To this end, CTLA-4 ligation may be achieved by using a DVD-Ig molecule, which target two different epitopes (or 2 copies of the same epitope) of CTLA-4 extracellular domain. The rationale is that the distance spanning two binding sites of an IgG, approximately 150-170 Å, is too large for active ligation of CTLA-4 (30-50 Å between 2 CTLA-4 homodimer). However the distance between the two binding sites on DVD-Ig (one arm) is much shorter, also in the range of 30-50 Å, allowing proper ligation of CTLA-4.

Similarly, DVD-Ig can target two different members of a cell surface receptor complex (e.g., IL-12R alpha and beta). Furthermore, DVD-Ig can target CR1 and a soluble protein/pathogen to drive rapid clearance of the target soluble protein/pathogen.

Additionally, DVD-Igs provided herein can be employed for tissue-specific delivery (target a tissue marker and a disease mediator for enhanced local PK thus higher efficacy and/or lower toxicity), including intracellular delivery (targeting an internalizing receptor and a intracellular molecule), and delivery to the inside of the brain (targeting transferrin receptor and a CNS disease mediator for crossing the blood-brain barrier). DVD-Ig can also serve as a carrier protein to deliver an antigen to a specific location via binding to a non-neutralizing epitope of that antigen and also to increase the half-life of the antigen. Furthermore, DVD-Ig can be designed to either be physically linked to medical devices implanted into patients or target these medical devices (see Burke, S. E. et al. (2006) Adv. Drug Deliv. Rev. 58(3): 437-446; Hildebrand, H. F. et al. (2006) Surface and Coatings Technol. 200(22-23): 6318-6324; Wu, P. et al. (2006) Biomaterials 27(11): 2450-2467; Marques, A. P. et al. (2005) Biodegrad. Syst. Tissue Eng. and Regen. Med. 377-397). Briefly, directing appropriate types of cell to the site of medical implant may promote healing and restoring normal tissue function. Alternatively, inhibition of mediators (including but not limited to cytokines), released upon device implantation by a DVD coupled to or target to a device is also provided. For example, stents have been used for years in interventional cardiology to clear blocked arteries and to improve the flow of blood to the heart muscle. However, traditional bare metal stents have been known to cause restenosis (re-narrowing of the artery in a treated area) in some patients and can lead to blood clots. Recently, an anti-CD34 antibody coated stent has been described which reduced restenosis and prevents blood clots from occurring by capturing endothelial progenitor cells (EPC) circulating throughout the blood. Endothelial cells are cells that line blood vessels, allowing blood to flow smoothly. The EPCs adhere to the hard surface of the stent forming a smooth layer that not only promotes healing but prevents restenosis and blood clots, complications previously associated with the use of stents (Aoji et al. (2005) J. Am. Coll. Cardiol. 45(10):1574-9). In addition to improving outcomes for patients requiring stents, there are also implications for patients requiring cardiovascular bypass surgery. For example, a prosthetic vascular conduit (artificial artery) coated with anti-EPC antibodies would eliminate the need to use arteries from patients legs or arms for bypass surgery grafts. This would reduce surgery and anesthesia times, which in turn will reduce coronary surgery deaths. DVD-Ig are designed in such a way that it binds to a cell surface marker (such as CD34) as well as a protein (or an epitope of any kind, including but not limited to proteins, lipids and polysaccharides) that has been coated on the implanted device to facilitate the cell recruitment. Such approaches can also be applied to other medical implants in general. Alternatively, DVD-Igs can be coated on medical devices and upon implantation and releasing all DVDs from the device (or any other need which may require additional fresh DVD-Ig, including aging and denaturation of the already loaded DVD-Ig) the device could be reloaded by systemic administration of fresh DVD-Ig to the patient, where the DVD-Ig is designed to binds to a target of interest (a cytokine, a cell surface marker (such as CD34) etc.) with one set of binding sites and to a target coated on the device (including a protein, an epitope of any kind, including but not limited to lipids, polysaccharides and polymers) with the other. This technology has the advantage of extending the usefulness of coated implants.

A. Use of DVD-Igs in Various Diseases

DVD-Ig molecules provided herein are also useful as therapeutic molecules to treat various diseases. Such DVD molecules may bind one or more targets involved in a specific disease. Examples of such targets in various diseases are described below.

A.1. Human Autoimmune and Inflammatory Response

Many proteins have been implicated in general autoimmune and inflammatory responses, including C5, CCL1 (1-309), CCL11 (eotaxin), CCL13 (mcp-4), CCL15 (MIP-1d), CCL16 (HCC-4), CCL17 (TARC), CCL18 (PARC), CCL19, CCL2 (mcp-1), CCL20 (MIP-3a), CCL21 (MIP-2), CCL23 (MPIF-1), CCL24 (MPIF-2/eotaxin-2), CCL25 (TECK), CCL26, CCL3 (MIP-1a), CCL4 (MIP-1b), CCL5 (RANTES), CCL7 (mcp-3), CCL8 (mcp-2), CXCL1, CXCL10 (IP-10), CXCL11 (1-TAC/IP-9), CXCL12 (SDF1), CXCL13, CXCL14, CXCL2, CXCL3, CXCL5 (ENA-78/LIX), CXCL6 (GCP-2), CXCL9, IL13, IL8, CCL13 (mcp-4), CCR1, CCR2, CCR3, CCR4, CCR5, CCR6, CCR7, CCR8, CCR9, CX3CR1, IL8RA, XCR1 (CCXCR1), IFNA2, IL10, IL13, IL17C, IL1A, IL1B, IL1F10, IL1F5, IL1F6, IL1F7, IL1F8, IL1F9, IL22, IL5, IL8, IL9, LTA, LTB, MIF, SCYE1 (endothelial Monocyte-activating cytokine), SPP1, TNF, TNFSF5, IFNA2, IL10RA, IL10RB, IL13, IL13RA1, IL5RA, IL9, IL9R, ABCF1, BCL6, C3, C4A, CEBPB, CRP, ICEBERG, IL1R1, IL1RN, IL8RB, LTB4R, TOLLIP, FADD, IRAK1, IRAK2, MYD88, NCK2, TNFAIP3, TRADD, TRAF1, TRAF2, TRAF3, TRAF4, TRAF5, TRAF6, ACVR1, ACVR1B, ACVR2, ACVR2B, ACVRL1, CD28, CD3E, CD3G, CD3Z, CD69, CD80, CD86, CNR1, CTLA4, CYSLTR1, FCER1A, FCER2, FCGR3A, GPR44, HAVCR2, OPRD1, P2RX7, TLR2, TLR3, TLR4, TLR5, TLR6, TLR7, TLR8, TLR9, TLR10, BLR1, CCL1, CCL2, CCL3, CCL4, CCL5, CCL7, CCL8, CCL11, CCL13, CCL15, CCL16, CCL17, CCL18, CCL19, CCL20, CCL21, CCL22, CCL23, CCL24, CCL25, CCR1, CCR2, CCR3, CCR4, CCR5, CCR6, CCR7, CCR8, CCR9, CX3CL1, CX3CR1, CXCL1, CXCL2, CXCL3, CXCL5, CXCL6, CXCL10, CXCL11, CXCL12, CXCL13, CXCR4, GPR2, SCYE1, SDF2, XCL1, XCL2, XCR1, AMH, AMHR2, BMPR1A, BMPR1B, BMPR2, C19orf10 (IL27w), CER1, CSF1, CSF2, CSF3, DKFZp451J0118, FGF2, GFI1, IFNA1, IFNB1, IFNG, IGF1, IL1A, IL1B, IL1R1, IL1R2, IL2, IL2RA, IL2RB, IL2RG, IL3, IL4, IL4R, IL5, IL5RA, IL6, IL6R, IL6ST, IL7, IL8, IL8RA, IL8RB, IL9, IL9R, IL10, IL10RA, IL10RB, IL11, IL11RA, IL12A, IL12B, IL12RB1, IL12RB2, IL13, IL13RA1, IL13RA2, IL15, IL15RA, IL16, IL17, IL17R, IL18, IL18R1, IL19, IL20, KITLG, LEP, LTA, LTB, LTB4R, LTB4R2, LTBR, MIF, NPPB, PDGFB, TBX21, TDGF1, TGFA, TGFB1, TGFB1I1, TGFB2, TGFB3, TGFBI, TGFBR1, TGFBR2, TGFBR3, TH1L, TNF, TNFRSF1A, TNFRSF1B, TNFRSF7, TNFRSF8, TNFRSF9, TNFRSF11A, TNFRSF21, TNFSF4, TNFSF5, TNFSF6, TNFSF11, VEGF, ZFPM2, and RNF110 (ZNF144). In one aspect, DVD-Igs that bind one or more of the targets listed herein are provided.

DVD Igs capable of binding the following pairs of targets to treat inflammatory disease are contemplated: IL-1β and IL-17.

A.2. Asthma

Allergic asthma is characterized by the presence of eosinophilia, goblet cell metaplasia, epithelial cell alterations, airway hyperreactivity (AHR), and Th2 and Th1 cytokine expression, as well as elevated serum IgE levels. It is now widely accepted that airway inflammation is the key factor underlying the pathogenesis of asthma, involving a complex interplay of inflammatory cells such as T cells, B cells, eosinophils, mast cells and macrophages, and of their secreted mediators including cytokines and chemokines. Corticosteroids are the most important anti-inflammatory treatment for asthma today, however their mechanism of action is non-specific and safety concerns exist, especially in the juvenile patient population. The development of more specific and targeted therapies is therefore warranted. There is increasing evidence that IL-13 in mice mimics many of the features of asthma, including AHR, mucus hypersecretion and airway fibrosis, independently of eosinophilic inflammation (Finotto et al. (2005) Int. Immunol. 17(8): 993-1007; Padilla et al. (2005) J. Immunol. 174(12): 8097-8105).

IL-13 has been implicated as having a pivotal role in causing pathological responses associated with asthma. The development of anti-IL-13 mAb therapy to reduce the effects of IL-13 in the lung is an exciting new approach that offers considerable promise as a novel treatment for asthma. However other mediators of differential immunological pathways are also involved in asthma pathogenesis, and blocking these mediators, in addition to IL-13, may offer additional therapeutic benefit. Such target pairs include, but are not limited to, IL-13 and a pro-inflammatory cytokine, such as tumor necrosis factor-α (TNF-α). TNF-α may amplify the inflammatory response in asthma and may be linked to disease severity (McDonnell, et al. (2001) Progr. Respir. Res. 31: 247-250). This suggests that blocking both IL-13 and TNF-α may have beneficial effects, particularly in severe airway disease. In another embodiment the DVD-Ig binds the targets IL-13 and TNFα and is used for treating asthma.

Animal models such as OVA-induced asthma mouse model, where both inflammation and AHR can be assessed, are known in the art and may be used to determine the ability of various DVD-Ig molecules to treat asthma. Animal models for studying asthma are disclosed in Coffman, et al. (2005) J. Exp. Med. 201(12): 1875-1879; Lloyd et al. (2001) Adv. Immunol. 77: 263-295; Boyce et al. (2005) J. Exp. Med. 201(12): 1869-1873; and Snibson et al. (2005) J. Brit. Soc. Allerg. Clin. Immunol. 35(2): 146-52. In addition to routine safety assessments of these target pairs, specific tests for the degree of immunosuppression may be warranted and helpful in selecting the best target pairs (see Luster et al. (1994) Toxicology 92(1-3): 229-43; Descotes, et al. (1992) Devel. Biol. Stand. 77: 99-102; Hart et al. (2001) J. Allerg. Clin. Immunol. 108(2): 250-257).

Based on the rationale disclosed herein and using the same evaluation model for efficacy and safety other pairs of targets that DVD-Ig molecules can bind and be useful to treat asthma may be determined. In an embodiment, such targets include, but are not limited to, IL-13 and IL-1beta, since IL-1 beta is also implicated in inflammatory response in asthma; IL-13 and cytokines and chemokines that are involved in inflammation, such as IL-9; IL-13 and IL-4; IL-13 and IL-5; IL-13 and IL-25; IL-13 and TARC; IL-13 and MDC; IL-13 and MIF; IL-13 and TGF-β; IL-13 and LHR agonist; IL-13 and CL25; IL-13 and SPRR2a; IL-13 and SPRR2b; and IL-13 and ADAM8. DVD-Igs capable of binding one or more targets involved in asthma, such as IL-1β and IL-17, are also provided.

A.3. Rheumatoid Arthritis

Rheumatoid arthritis (RA), a systemic disease, is characterized by a chronic inflammatory reaction in the synovium of joints and is associated with degeneration of cartilage and erosion of juxta-articular bone. Many pro-inflammatory cytokines including TNF, chemokines, and growth factors are expressed in diseased joints. Systemic administration of anti-TNF antibody or sTNFR fusion protein to mouse models of RA was shown to be anti-inflammatory and joint protective. Clinical investigations in which the activity of TNF in RA patients was blocked with intravenously administered infliximab (Harriman, G. et al. (1999) Ann. Rheum. Dis. 58 (Suppl 1): 161-4), a chimeric anti-TNF mAb, has provided evidence that TNF regulates IL-6, IL-8, MCP-1, and VEGF production, recruitment of immune and inflammatory cells into joints, angiogenesis, and reduction of blood levels of matrix metalloproteinases-1 and -3. A better understanding of the inflammatory pathway in rheumatoid arthritis has led to identification of other therapeutic targets involved in rheumatoid arthritis. Promising treatments such as interleukin-6 antagonists (IL-6 receptor antibody MRA, developed by Chugai, Roche (see Nishimoto, N. et al. (2004) Arthrit. Rheum. 50(6): 1761-1769), CTLA4Ig (abatacept, Genovese, M. et al. (2005) N. Engl. J. Med. 353: 1114-23.), and anti-B cell therapy (rituximab; Okamoto, H. and Kamatani, N. (2004) N. Engl. J. Med. 351: 1909), have already been tested in randomized controlled trials over the past year. Other cytokines have been identified and have been shown to be of benefit in animal models, including interleukin-15 (therapeutic antibody HuMax-IL_15, AMG 714 (see Baslund, B. et al. (2005) Arthrit. Rheum. 52(9): 2686-2692)), interleukin-17, and interleukin-18, and clinical trials of these agents are currently under way. Dual-specific antibody therapy, combining anti-TNF and another mediator, has great potential in enhancing clinical efficacy and/or patient coverage. For example, blocking both TNF and VEGF can potentially eradicate inflammation and angiogenesis, both of which are involved in pathophysiology of RA. Blocking other pairs of targets involved in RA including, but not limited to: IL-1β and IL-17. In addition to routine safety assessments of these target pairs, specific tests for the degree of immunosuppression may be warranted and helpful in selecting the best target pairs (see Luster et al. (1994) Toxicol. 92(1-3): 229-43; Descotes et al. (1992) Devel. Biol. Stand. 77: 99-102; Hart et al. (2001) J. Allerg. Clin. Immunol. 108(2): 250-257). Whether a DVD Ig molecule will be useful for the treatment of rheumatoid arthritis can be assessed using pre-clinical animal RA models such as the collagen-induced arthritis mouse model. Other useful models are also well known in the art (see Brand, D. D. (2005) Comp. Med. 55(2): 114-22). Based on the cross-reactivity of the parental antibodies for human and mouse othologues (e.g., reactivity for human and mouse TNF, human and mouse IL-15, etc.) validation studies in the mouse CIA model may be conducted with "matched surrogate antibody" derived DVD-Ig molecules; briefly, a DVD-Ig based on two (or more) mouse target specific antibodies may be matched to the extent possible to the characteristics of the parental human or humanized antibodies used for human DVD-Ig construction (similar affinity, similar neutralization potency, similar half-life etc.).

A.4. SLE

The immunopathogenic hallmark of SLE is the polyclonal B cell activation, which leads to hyperglobulinemia, autoantibody production and immune complex formation. The fundamental abnormality appears to be the failure of T cells to suppress the forbidden B cell clones due to generalized T cell dysregulation. In addition, B and T-cell interaction is facilitated by several cytokines such as IL-10 as well as co-stimulatory molecules such as CD40 and CD40L, B7 and CD28 and CTLA-4, which initiate the second signal. These interactions together with impaired phagocytic clearance of immune complexes and apoptotic material, perpetuate the immune response with resultant tissue injury. The following targets may be involved in SLE and can potentially be used for a DVD-Ig approach for therapeutic intervention: B cell targeted therapies: CD-20, CD-22, CD-19, CD28, CD4, CD80, HLA-DRA, IL10, IL2, IL4, TNFRSF5, TNFRSF6, TNFSF5, TNFSF6, BLR1, HDAC4, HDAC5, HDAC7A, HDAC9, ICOSL, IGBP1, MS4A1, RGS1, SLA2, CD81, IFNB1, IL10, TNFRSF5, TNFRSF7, TNFSF5, AICDA, BLNK, GALNAC4S-6ST, HDAC4, HDAC5, HDAC7A, HDAC9, IL10, IL11, IL4, INHA, INHBA, KLF6, TNFRSF7, CD28, CD38, CD69, CD80, CD83, CD86, DPP4, FCER2, IL2RA, TNFRSF8, TNFSF7, CD24, CD37, CD40, CD72, CD74, CD79A, CD79B, CR2, IL1R2, ITGA2, ITGA3, MS4A1, ST6GAL1, CD1C, CHST10, HLA-A, HLA-DRA, and NT5E.; co-stimulatory signals: CTLA4 or B7.1/B7.2; inhibition of B cell survival: BlyS or BAFF; Complement inactivation: C5; Cytokine modulation: the key principle is that the net biologic response in any tissue is the result of a balance between local levels of proinflammatory or anti-inflammatory cytokines (see Sfikakis, P. P. et al. (2005) Curr. Opin. Rheumatol. 17:550-7). SLE is considered to be a Th-2 driven disease with documented elevations in serum IL-4, IL-6, IL-10. DVD-Igs that bind one or more of IL-4, IL-6, IL-10, IFN-α, TNF-α, IL-β, or IL-17 are also contemplated. Combination of targets discussed herein will enhance therapeutic efficacy for SLE which can be tested in a number of lupus preclinical models (see Peng, S. L. (2004) Methods Mol. Med. 102:227-72). Based on the cross-reactivity of the parental antibodies for human and mouse othologues (e.g., reactivity for human and mouse CD20, human and mouse Interferon alpha etc.) validation studies in a mouse lupus model may be conducted with "matched surrogate antibody" derived DVD-Ig molecules. Briefly, a DVD-Ig based two (or more) mouse target specific antibodies may be matched to the extent possible to the characteristics of the parental human or humanized antibodies used for human DVD-Ig construction (similar affinity, similar neutralization potency, similar half-life etc.).

A.5. Multiple Sclerosis

Multiple sclerosis (MS) is a complex human autoimmune-type disease with a predominantly unknown etiology. Immunologic destruction of myelin basic protein (MBP) throughout the nervous system is the major pathology of multiple sclerosis. MS is a disease of complex pathologies, which involves infiltration by CD4+ and CD8+ T cells and of response within the central nervous system. Expression in the CNS of cytokines, reactive nitrogen species and costimulator molecules have all been described in MS. Of major consideration are immunological mechanisms that contribute to the development of autoimmunity. In particular, antigen expression, cytokine and leukocyte interactions, and regulatory T-cells, which help balance/modulate other T-cells such as Th1 and Th2 cells, are important areas for therapeutic target identification.

IL-12 is a proinflammatory cytokine that is produced by APC and promotes differentiation of Th1 effector cells. IL-12 is produced in the developing lesions of patients with MS as well as in EAE-affected animals. Previously it was shown that interference in IL-12 pathways effectively prevents EAE in rodents, and that in vivo neutralization of IL-12p40 using a anti-IL-12 mAb has beneficial effects in the myelin-induced EAE model in common marmosets.

TWEAK is a member of the TNF family, constitutively expressed in the central nervous system (CNS), with proinflammatory, proliferative or apoptotic effects depending upon cell types. Its receptor, Fn14, is expressed in CNS by endothelial cells, reactive astrocytes and neurons. TWEAK and Fn14 mRNA expression increased in spinal cord during experimental autoimmune encephalomyelitis (EAE). Anti-TWEAK antibody treatment in myelin oligodendrocyte glycoprotein (MOG) induced EAE in C57BL/6 mice resulted in a reduction of disease severity and leukocyte infiltration when mice were treated after the priming phase.

DVD Ig molecules capable of binding one or more, for example two, targets such as IL-1β and IL-17 are provided. An embodiment includes a dual-specific anti-IL-1β/IL-17 DVD Ig as a therapeutic agent beneficial for the treatment of MS.

Several animal models for assessing the usefulness of the DVD molecules to treat MS are known in the art (see Steinman. L. et al. (2005) Trends Immunol. 26(11): 565-71; Lublin, F. D. et al. (1985) Springer Semin. Immunopathol. 8(3): 197-208; Genain, C. P. et al. (1997) J. Mol. Med. 75(3): 187-97; Tuohy, V. K. et al. (1999) J. Exp. Med. 189(7): 1033-42; Owens, T. et al. (1995) Neurol. Clin. 13(1): 51-73; and Hart, B. A. et al. (2005) J. Immunol. 175(7): 4761-8. Based on the cross-reactivity of the parental antibodies for human and animal species othologues (e.g., reactivity for human and mouse IL-12, human and mouse TWEAK etc.), validation studies in the mouse EAE model may be conducted with "matched surrogate antibody" derived DVD-Ig molecules. Briefly, a DVD-Ig based on two (or more) mouse target specific antibodies may be matched to the extent possible to the characteristics of the parental human or humanized antibodies used for human DVD-Ig construction (similar affinity, similar neutralization potency, similar half-life etc.). The same concept applies to animal models in other non-rodent species, where a "matched surrogate antibody" derived DVD-Ig would be selected for the anticipated pharmacology and possibly safety studies. In addition to routine safety assessments of these target pairs specific tests for the degree of immunosuppression may be warranted and helpful in selecting the best target pairs (see Luster et al. (1994) Toxicol. 92(1-3): 229-43; Descotes et al. (1992) Devel. Biol. Stand. 77: 99-102; Jones, R. (2000) (Drugs 3(4): 442-6).

A.6. Sepsis

The pathophysiology of sepsis is initiated by the outer membrane components of both gram-negative organisms (lipopolysaccharide [LPS], lipid A, endotoxin) and gram-positive organisms (lipoteichoic acid, peptidoglycan). These outer membrane components are able to bind to the CD14 receptor on the surface of monocytes. By virtue of the recently described toll-like receptors, a signal is then transmitted to the cell, leading to the eventual production of the proinflammatory cytokines tumor necrosis factor-alpha (TNF-alpha) and interleukin-1 (IL-1). Overwhelming inflammatory and immune responses are essential features of septic shock and play a central part in the pathogenesis of tissue damage, multiple organ failure, and death induced by sepsis. Cytokines, especially tumor necrosis factor (TNF) and interleukin (IL-1), have been shown to be critical mediators of septic shock. These cytokines have a direct toxic effect on tissues; they also activate phospholipase A2. These and other effects lead to increased concentrations of platelet-activating factor, promotion of nitric oxide synthase activity, promotion of tissue infiltration by neutrophils, and promotion of neutrophil activity.

The treatment of sepsis and septic shock remains a clinical conundrum, and recent prospective trials with biological response modifiers (i.e., anti-TNF and anti-MIF) aimed at the inflammatory response have shown only modest clinical benefit. Recently, interest has shifted toward therapies aimed at reversing the accompanying periods of immune suppression. Studies in experimental animals and critically ill patients have demonstrated that increased apoptosis of lymphoid organs and some parenchymal tissues contribute to this immune suppression, anergy, and organ system dysfunction. During sepsis syndromes, lymphocyte apoptosis can be triggered by the absence of IL-2 or by the release of glucocorticoids, granzymes, or the so-called 'death' cytokines: tumor necrosis factor alpha or Fas ligand. Apoptosis proceeds via auto-activation of cytosolic and/or mitochondrial caspases, which can be influenced by the pro- and anti-apoptotic members of the Bcl-2 family. In experimental animals, not only can treatment with inhibitors of apoptosis prevent lymphoid cell apoptosis; it may also improve outcome. Although clinical trials with anti-apoptotic agents remain distant due in large part to technical difficulties associated with their administration and tissue targeting, inhibition of lymphocyte apoptosis represents an attractive therapeutic target for the septic patient. Likewise, a dual-specific agent targeting both inflammatory mediator and an apoptotic mediator, may have added benefit. DVD Igs are provided that are capable of binding one or more targets involved in sepsis, in an embodiment two targets. In some embodiments, the targets are TNF, IL-1, MIF, IL-6, IL-8, IL-18, IL-12, IL-23, FasL, LPS, Toll-like receptors, TLR-4, tissue factor, MIP-2, ADORA2A, CASP1, CASP4, IL-10, IL-1B, NFKB1, PROC, TNFRSF1A, CSF3, CCR3, IL1RN, MIF, NFKB1, PTAFR, TLR2, TLR4, GPR44, HMOX1, midkine, IRAK1, NFKB2, SERPINA1, SERPINE1, or TREM1. The efficacy of such DVD Igs for sepsis can be assessed in preclinical animal models known in the art (see Buras, J. A., et al. (2005) Nat. Rev. Drug Discov. 4(10):854-65 and Calandra T, et al. (2000) Nat. Med. 6(2):164-70). In an embodiment, an anti-IL-1β and IL-17 DVD-Ig is used to treat sepsis.

A.7. Neurological Disorders

A.7.1. Neurodegenerative Diseases

Neurodegenerative diseases are either chronic in which case they are usually age-dependent or acute (e.g., stroke, traumatic brain injury, spinal cord injury, etc.). They are characterized by progressive loss of neuronal functions (neuronal cell death, demyelination), loss of mobility and loss of memory. Emerging knowledge of the mechanisms underlying chronic neurodegenerative diseases (e.g., Alzheimer's disease disease) show a complex etiology and a variety of factors have been recognized to contribute to their development and progression e.g., age, glycemic status, amyloid production and multimerization, accumulation of advanced glycation-end products (AGE) which bind to their receptor RAGE (receptor for AGE), increased brain oxidative stress, decreased cerebral blood flow, neuroinflammation including release of inflammatory cytokines and chemokines, neuronal dysfunction and microglial activation. Thus these chronic neurodegenerative diseases represent a complex interaction between multiple cell types and mediators. Treatment strategies for such diseases are limited and mostly constitute either blocking inflammatory processes with non-specific anti-inflammatory agents (e.g., corticosteroids, COX inhibitors) or agents to prevent neuron loss and/or synaptic functions. These treatments fail to stop disease progression. Recent studies suggest that more targeted therapies such as antibodies to soluble A-b peptide (including the A-b oligomeric forms) can not only help stop disease progression but may help maintain memory as well. These preliminary observations suggest that specific therapies targeting more than one disease mediator (e.g., A-b and a pro-inflammatory cytokine, such as TNF) may provide even better therapeutic efficacy for chronic neurodegenerative diseases than observed with targeting a single disease mechanism (e.g., soluble A-β alone) Several animal models for assessing the usefulness of the DVD molecules to treat MS are known in the art (see Steinman. L. et al. (2005) Trends Immunol. 26(11): 565-71; Lublin, F. D. et al. (1985) Springer Semin. Immunopathol. 8(3): 197-208; Genain, C. P. et al. (1997) J. Mol. Med. 75(3): 187-97; Tuohy, V. K. et al. (1999) J. Exp. Med. 189(7): 1033-42; Owens, T. et al. (1995) Neurol. Clin. 13(1): 51-73; and Hart, B. A. et al. (2005) J. Immunol. 175(7): 4761-8. Based on the cross-reactivity of the parental antibodies for human and animal species othologues (e.g., reactivity for human and mouse IL-12, human and mouse TWEAK etc.), validation studies in the mouse EAE model may be conducted with "matched surrogate antibody" derived DVD-Ig molecules. Briefly, a DVD-Ig based on two (or more) mouse target specific antibodies may be matched to the extent possible to the characteristics of the parental human or humanized antibodies used for human DVD-Ig construction (similar affinity, similar neutralization potency, similar half-life etc.). The same concept applies to animal models in other non-rodent species, where a "matched surrogate antibody" derived DVD-Ig would be selected for the anticipated pharmacology and possibly safety studies. In addition to routine safety assessments of these target pairs specific tests for the degree of immunosuppression may be warranted and helpful in selecting the best target pairs (see Luster et al. (1994) Toxicol. 92(1-3): 229-43; Descotes et al. (1992) Devel. Biol. Stand. 77: 99-102; Jones, R. (2000) (Drugs 3(4): 442-6).

The DVD-Ig molecules can bind one or more targets involved in chronic neurodegenerative diseases such as Alzheimers. Such targets include, but are not limited to, any mediator, soluble or cell surface, implicated in AD pathogenesis e.g AGE (S100 A, amphoterin), pro-inflammatory cytokines (e.g., IL-1), chemokines (e.g., MCP 1), molecules that inhibit nerve regeneration (e.g., Nogo, RGM A), molecules that enhance neurite growth (neurotrophins) and molecules that can mediate transport at the blood brain barrier (e.g., transferrin receptor, insulin receptor or RAGE). The efficacy of DVD-Ig molecules can be validated in pre-clinical animal models such as the transgenic mice that over-express amyloid precursor protein or RAGE and develop Alzheimer's disease-like symptoms. In addition, DVD-Ig molecules can be constructed and tested for efficacy in the animal models and the best therapeutic DVD-Ig can be selected for testing in human patients. DVD-Ig molecules can also be employed for treatment of other neurodegenerative diseases such as Parkinson's disease. Alpha-Synuclein is involved in Parkinson's pathology. A DVD-Ig capable of targeting alpha-synuclein and inflammatory mediators such as TNF, IL-1, MCP-1 can prove effective therapy for Parkinson's disease and are also contemplated. In an embodiment, an anti-IL-1β and IL-17 DVD-Ig is used to treat neurodegenerative disease.

A.7.2. Neuronal Regeneration and Spinal Cord Injury

Despite an increase in knowledge of the pathologic mechanisms, spinal cord injury (SCI) is still a devastating condition and represents a medical indication characterized by a high medical need. Most spinal cord injuries are contusion or compression injuries and the primary injury is usually followed by secondary injury mechanisms (inflammatory mediators e.g., cytokines and chemokines) that worsen the initial injury and result in significant enlargement of the lesion area, sometimes more than 10-fold. These primary and secondary mechanisms in SCI are very similar to those in brain injury caused by other means e.g., stroke. No satisfying treatment exists and high dose bolus injection of methylprednisolone (MP) is the only used therapy within a narrow time window of 8 h post injury. This treatment, however, is only intended to prevent secondary injury without causing any significant functional recovery. It is heavily criticized for the lack of unequivocal efficacy and severe adverse effects, like immunosuppression with subsequent infections and severe histopathological muscle alterations. No other drugs, biologics or small molecules, stimulating the endogenous regenerative potential are approved, but promising treatment principles and drug candidates have shown efficacy in animal models of SCI in recent years. To a large extent the lack of functional recovery in human SCI is caused by factors inhibiting neurite growth, at lesion sites, in scar tissue, in myelin as well as on injury-associated cells. Such factors are the myelin-associated proteins NogoA, OMgp and MAG, RGM A, the scar-associated CSPG (Chondroitin Sulfate Proteoglycans) and inhibitory factors on reactive astrocytes (some semaphorins and ephrins). However, at the lesion site not only growth inhibitory molecules are found but also neurite growth stimulating factors like neurotrophins, laminin, L1 and others. This ensemble of neurite growth inhibitory and growth promoting molecules may explain that blocking single factors, like NogoA or RGM A, resulted in significant functional recovery in rodent SCI models, because a reduction of the inhibitory influences could shift the balance from growth inhibition to growth promotion. However, recoveries observed with blocking a single neurite outgrowth inhibitory molecule were not complete. To achieve faster and more pronounced recoveries either blocking two neurite outgrowth inhibitory molecules, e.g., Nogo and RGM A, or blocking an neurite outgrowth inhibitory molecule and enhancing functions of a neurite outgrowth enhancing molecule e.g Nogo and neurotrophins, or blocking a neurite outgrowth inhibitory moleclule e.g., Nogo and a pro-inflammatory molecule e.g., TNF, may be desirable (see McGee, A. W. et al. (2003) Trends Neurosci. 26: 193; Domeniconi, M. et al. (2005) J. Neurol. Sci. 233: 43; Makwana1, M. et al. (2005) FEBS J. 272: 2628; Dickson, B. J. (2002) Science 298: 1959; Yu, F. and Teng, H. et al. (2005) J. Neurosci. Res. 79: 273; Karnezis, T. et al. (2004) Nature Neurosci. 7: 736; Xu, G. et al. (2004) J. Neurochem. 91: 1018).

In one aspect, DVD-Igs capable of binding target pairs such as NgR and RGM A; NogoA and RGM A; MAG and RGM A; OMGp and RGM A; RGM A and RGM B; CSPGs and RGM A; aggrecan, midkine, neurocan, versican, phosphacan, Te38 and TNF-α; Aβ globulomer-specific antibodies combined with antibodies promoting dendrite & axon sprouting are provided. Dendrite pathology is a very early sign of AD and it is known that NOGO A restricts dendrite growth. One can combine one such type of Ab with any of the SCI-candidate (myelin-proteins) Abs. Other DVD-Ig targets may include any combination of NgR-p75, NgR-Troy, NgR-Nogo66 (Nogo), NgR-Lingo, Lingo-Troy, Lingo-p75, MAG and Omgp. Additionally, targets may also include any mediator, soluble or cell surface, implicated in inhibition of neurite e.g., Nogo, Ompg, MAG, RGM A, semaphorins, ephrins, soluble A-b, pro-inflammatory cytokines (e.g., IL-1), chemokines (e.g., MIP 1a), molecules that inhibit nerve regeneration. The efficacy of anti-nogo/anti-RGM A or similar DVD-Ig molecules can be validated in pre-clinical animal models of spinal cord injury. In addition, these DVD-Ig molecules can be constructed and tested for efficacy in the animal models and the best therapeutic DVD-Ig can be selected for testing in human patients. In addition, DVD-Ig molecules can be constructed that target two distinct ligand binding sites on a single receptor e.g., Nogo receptor, which binds the three ligand Nogo, Ompg, and MAG and RAGE that binds A-b and S100 A. Furthermore, neurite outgrowth inhibitors e.g., nogo and nogo receptor, also play a role in preventing nerve regeneration in immunological diseases like multiple sclerosis. Inhibition of nogo-nogo receptor interaction has been shown to enhance recovery in animal models of multiple sclerosis. Therefore, DVD-Ig molecules that can block the function of one immune mediator, e.g., a cytokine, like IL-12, and a neurite outgrowth inhibitor molecule eg nogo or RGM may offer faster and greater efficacy than blocking either an immune or an neurite outgrowth inhibitor molecule alone.

In general, antibodies do not cross the blood brain barrier (BBB) in an efficient and relevant manner. However, in certain neurologic diseases, e.g., stroke, traumatic brain injury, multiple sclerosis, etc., the BBB may be compromised and allows for increased penetration of DVD-Igs and antibodies into the brain. In other neurological conditions, where BBB leakage is not occurring, one may employ the targeting of endogenous transport systems, including carrier-mediated transporters such as glucose and amino acid carriers and receptor-mediated transcytosis-mediating cell structures/receptors at the vascular endothelium of the BBB, thus enabling trans-BBB transport of the DVD-Ig. Structures at the BBB enabling such transport include but are not limited to the insulin receptor, transferrin receptor, LRP and RAGE. In addition, strategies enable the use of DVD-Igs also as shuttles to transport potential drugs into the CNS including low molecular weight drugs, nanoparticles and nucleic acids (Coloma, M. J. et al. (2000) Pharm Res. 17(3):266-74; Boado, R. J. et al. (2007) Bioconjug. Chem. 18(2):447-55). In an embodiment, an anti-IL-1β and IL-17 DVD-Ig is used to treat neuronal regeneration and spinal cord injury.

A.8. Oncological Disorders

Monoclonal antibody therapy has emerged as an important therapeutic modality for cancer (von Mehren, M, et al. (2003) Annu. Rev. Med. 54:343-69). Antibodies may exert antitumor effects by inducing apoptosis, redirecting cytotoxicity, interfering with ligand-receptor interactions, or preventing the expression of proteins that are critical to the neoplastic phenotype. In addition, antibodies can target components of the tumor microenvironment, perturbing vital structures such as the formation of tumor-associated vasculature. Antibodies can also target receptors whose ligands are growth factors, such as the epidermal growth factor receptor. The antibody thus inhibits natural ligands that stimulate cell growth from binding to targeted tumor cells. Alternatively, antibodies may induce an anti-idiotype network, complement-mediated cytotoxicity, or antibody-dependent cellular cytotoxicity (ADCC). The use of dual-specific antibody that targets two separate tumor mediators will likely give additional benefit compared to a mono-specific therapy. DVD Igs capable of binding the following pairs of targets to treat oncological disease are also contemplated: IL-1β and IL-17.

In another embodiment, the DVD Ig is capable of binding VEGF and phosphatidylserine; VEGF and ErbB3; VEGF and PLGF; VEGF and ROBO4; VEGF and BSG2; VEGF and CDCP1; VEGF and ANPEP; VEGF and c-MET; HER-2 and ERB3; HER-2 and BSG2; HER-2 and CDCP1; HER-2 and ANPEP; EGFR and CD64; EGFR and BSG2; EGFR and CDCP1; EGFR and ANPEP; IGF1R and PDGFR; IGF1R and VEGF; IGF1R and CD20; CD20 and CD74; CD20 and CD30; CD20 and DR4; CD20 and VEGFR2; CD20 and CD52; CD20 and CD4; HGF and c-MET; HGF and NRP1; HGF and phosphatidylserine; ErbB3 and IGF1R; ErbB3 and IGF1,2; c-Met and Her-2; c-Met and NRP1; c-Met and IGF1R; IGF1,2 and PDGFR; IGF1,2 and CD20; IGF1,2 and IGF1R; IGF2 and EGFR; IGF2 and HER2; IGF2 and CD20; IGF2 and VEGF; IGF2 and IGF1R; IGF1 and IGF2; PDGFRa and VEGFR2; PDGFRa and PLGF; PDGFRa and VEGF; PDGFRa and c-Met; PDGFRa and EGFR; PDGFRb and VEGFR2; PDGFRb and c-Met; PDGFRb and EGFR; RON and c-Met; RON and MTSP1; RON and MSP; RON and CDCP1; VGFR1 and PLGF; VGFR1 and RON; VGFR1 and EGFR; VEGFR2 and PLGF; VEGFR2 and NRP1; VEGFR2 and RON; VEGFR2 and DLL4; VEGFR2 and EGFR; VEGFR2 and ROBO4; VEGFR2 and CD55; LPA and S1P; EPHB2 and RON; CTLA4 and VEGF; CD3 and EPCAM; CD40 and IL6; CD40 and IGF; CD40 and CD56; CD40 and CD70; CD40 and VEGFR1; CD40 and DR5; CD40 and DR4; CD40 and APRIL; CD40 and BCMA; CD40 and RANKL; CD28 and MAPG; CD80 and CD40; CD80 and CD30; CD80 and CD33; CD80 and CD74; CD80 and CD2; CD80 and CD3; CD80 and CD19; CD80 and CD4; CD80 and CD52; CD80 and VEGF; CD80 and DR5; CD80 and VEGFR2; CD22 and CD20; CD22 and CD80; CD22 and CD40; CD22 and CD23; CD22 and CD33; CD22 and CD74; CD22 and CD19; CD22 and DR5; CD22 and DR4; CD22 and VEGF; CD22 and CD52; CD30 and CD20; CD30 and CD22; CD30 and CD23; CD30 and CD40; CD30 and VEGF; CD30 and CD74; CD30 and CD19; CD30 and DR5; CD30 and DR4; CD30 and VEGFR2; CD30 and CD52; CD30 and CD4; CD138 and RANKL; CD33 and FTL3; CD33 and VEGF; CD33 and VEGFR2; CD33 and CD44; CD33 and DR4; CD33 and DR5; DR4 and CD137; DR4 and IGF1,2; DR4 and IGF1R; DR4 and DR5; DR5 and CD40; DR5 and CD137; DR5 and CD20; DR5 and EGFR; DR5 and IGF1,2; DR5 and IGFR, DR5 and HER-2, and EGFR and DLL4. Other target combinations include one or more members of the EGF/erb-2/erb-3 family. Other targets (one or more) involved in oncological diseases that DVD Igs may bind include, but are not limited to: CD52, CD20, CD19, CD3, CD4, CD8, BMP6, IL12A, IL1A, IL1B, IL2, IL24, INHA, TNF, TNFSF10, BMP6, EGF, FGF1, FGF10, FGF11, FGF12, FGF13, FGF14, FGF16, FGF17, FGF18, FGF19, FGF2, FGF20, FGF21, FGF22, FGF23, FGF3, FGF4, FGF5, FGF6, FGF7, FGF8, FGF9, GRP, IGF1, IGF2, IL12A, IL1A, IL1B, IL2, INHA, TGFA, TGFB1, TGFB2, TGFB3, VEGF, CDK2, FGF10, FGF18, FGF2, FGF4, FGF7, IGF1R, IL2, BCL2, CD164, CDKN1A, CDKN1B, CDKN1C, CDKN2A, CDKN2B, CDKN2C, CDKN3, GNRH1, IGFBP6, IL1A, IL1B, ODZ1, PAWR, PLG, TGFB1I1, AR, BRCA1, CDK3, CDK4, CDK5, CDK6, CDK7, CDK9, E2F1, EGFR, ENO1, ERBB2, ESR1, ESR2, IGFBP3, IGFBP6, IL2, INSL4, MYC, NOX5, NR6A1, PAP, PCNA, PRKCQ, PRKD1, PRL, TP53, FGF22, FGF23, FGF9, IGFBP3, IL2, INHA, KLK6, TP53, CHGB, GNRH1, IGF1, IGF2, INHA, INSL3, INSL4, PRL, KLK6, SHBG, NR1D1, NR1H3, NR1I3, NR2F6, NR4A3, ESR1, ESR2, NR0B1, NR0B2, NR1D2, NR1H2, NR1H4, NR1I2, NR2C1, NR2C2, NR2E1, NR2E3, NR2F1, NR2F2, NR3C1, NR3C2, NR4A1, NR4A2, NR5A1, NR5A2, NR6A1, PGR, RARB, FGF1, FGF2, FGF6, KLK3, KRT1, APOC1, BRCA1, CHGA, CHGB, CLU, COL1A1, COL6A1, EGF, ERBB2, ERK8, FGF1, FGF10, FGF11, FGF13, FGF14, FGF16, FGF17, FGF18, FGF2, FGF20, FGF21, FGF22, FGF23, FGF3, FGF4, FGF5, FGF6, FGF7, FGF8, FGF9, GNRH1, IGF1, IGF2, IGFBP3, IGFBP6, IL12A, IL1A, IL1B, IL2, IL24, INHA, INSL3, INSL4, KLK10, KLK12, KLK13, KLK14, KLK15, KLK3, KLK4, KLK5, KLK6, KLK9, MMP2, MMP9, MSMB, NTN4, ODZ1, PAP, PLAU, PRL, PSAP, SERPINA3, SHBG, TGFA, TIMP3, CD44, CDH1, CDH10, CDH19, CDH20, CDH7, CDH9, CDH1, CDH10, CDH13, CDH18, CDH19, CDH20, CDH7, CDH8, CDH9, ROBO2, CD44, ILK, ITGA1, APC, CD164, COL6A1, MTSS1, PAP, TGFB1I1, AGR2, AIG1, AKAP1, AKAP2, CANT1, CAV1, CDH12, CLDN3, CLN3, CYB5, CYC1, DAB2IP, DES, DNCL1, ELAC2, ENO2, ENO3, FASN, FLJ12584, FLJ25530, GAGEB1, GAGEC1, GGT1, GSTP1, HIP1, HUMCYT2A, IL29, K6HF, KAI1, KRT2A, MIB1, PART1, PATE, PCA3, PIAS2, PIK3CG, PPID, PR1, PSCA, SLC2A2, SLC33A1, SLC43A1, STEAP, STEAP2, TPM1, TPM2, TRPC6, ANGPT1, ANGPT2, ANPEP, ECGF1, EREG, FGF1, FGF2, FIGF, FLT1, JAG1, KDR, LAMA5, NRP1, NRP2, PGF, PLXDC1, STAB1, VEGF, VEGFC, ANGPTL3, BAI1, COL4A3, IL8, LAMA5, NRP1, NRP2, STAB1, ANGPTL4, PECAM1, PF4, PROK2, SERPINF1, TNFAIP2, CCL11, CCL2, CXCL1, CXCL10, CXCL3, CXCL5, CXCL6, CXCL9, IFNA1, IFNB1, IFNG, IL1B, IL6, MDK, EDG1, EFNA1, EFNA3, EFNB2, EGF, EPHB4, FGFR3, HGF, IGF1, ITGB3, PDGFA, TEK, TGFA, TGFB1, TGFB2, TGFBR1, CCL2, CDH5, COL18A1, EDG1, ENG, ITGAV, ITGB3, THBS1, THBS2, BAD, BAG1, BCL2, CCNA1, CCNA2, CCND1, CCNE1, CCNE2, CDH1 (E-cadherin), CDKN1B (p27Kip1), CDKN2A (p161NK4a), COL6A1, CTNNB1 (b-catenin), CTSB (cathepsin B), ERBB2 (Her-2), ESR1, ESR2, F3 (TF), FOSL1 (FRA-1), GATA3, GSN (Gelsolin), IGFBP2, IL2RA, IL6, IL6R, IL6ST (glycoprotein 130), ITGA6 (a6 integrin), JUN, KLK5, KRT19, MAP2K7 (c-Jun), MKI67 (Ki-67), NGFB (NGF), NGFR, NME1 (NM23A), PGR, PLAU (uPA), PTEN, SERPINB5 (maspin), SERPINE1 (PAI-1), TGFA, THBS1 (thrombospondin-1), TIE (Tie-1), TNFRSF6 (Fas), TNFSF6 (FasL), TOP2A (topoisomerase lia), TP53, AZGP1 (zinc-a-glycoprotein), BPAG1 (plectin), CDKN1A (p21Wap1/Cip1), CLDN7 (claudin-7), CLU (clusterin), ERBB2 (Her-2), FGF1, FLRT1 (fibronectin), GABRP (GABAa), GNAS1, ID2, ITGA6 (a6 integrin), ITGB4 (b 4 integrin), KLF5 (GC Box BP), KRT19 (Keratin 19), KRTHB6 (hair-specific type II keratin), MACMARCKS, MT3 (metallothionectin-III), MUC1 (mucin), PTGS2 (COX-2), RAC2 (p21Rac2), S100A2, SCGB1D2 (lipophilin B), SCGB2A1 (mammaglobin 2), SCGB2A2 (mammaglobin 1), SPRR1B (Spr1), THBS1, THBS2, THBS4, and TNFAIP2 (B94), RON, c-Met, CD64, DLL4, PLGF, CTLA4, phophatidylserine, ROBO4, CD80, CD22, CD40, CD23, CD28, CD80, CD55, CD38, CD70, CD74, CD30, CD138, CD56, CD33, CD2, CD137, DR4, DR5, RANKL, VEGFR2, PDGFR, VEGFR1, MTSP1, MSP, EPHB2, EPHA1, EPHA2, EpCAM, PGE2, NKG2D, LPA, SIP, APRIL, BCMA, MAPG, FLT3, PDGFR alpha, PDGFR beta, ROR1, PSMA, PSCA, SCD1, or CD59.

IV. Pharmaceutical Compositions

Pharmaceutical compositions comprising a binding protein and a pharmaceutically acceptable carrier are also provided. In some embodiments, the pharmaceutical compositions are for use in, but not limited to, diagnosing, detecting, or monitoring a disorder, in preventing (e.g., inhibiting or delaying the onset of a disease, disorder or other condition), treating, managing, or ameliorating of a disorder or one or more symptoms thereof, and/or in research. In a specific embodiment, a composition comprises one or more binding proteins provided herein. In another embodiment, the pharmaceutical composition comprises one or more binding proteins provided herein and one or more prophylactic or therapeutic agents other than binding proteins provided herein for treating a disorder. In an embodiment, the prophylactic or therapeutic agents are useful for or have been or currently are being used in the prevention, treatment, management, or amelioration of a disorder or one or more symptoms thereof. In accordance with these embodiments, the composition may further comprise a carrier, diluent or excipient.

The binding proteins provided herein can be incorporated into pharmaceutical compositions suitable for administration to a subject. Typically, the pharmaceutical composition comprises a binding protein provided herein and a pharmaceutically acceptable carrier. As used herein, "pharmaceutically acceptable carrier" includes any and all solvents, dispersion media, coatings, antibacterial and antifungal agents, isotonic and absorption delaying agents, and the like that are physiologically compatible. Examples of pharmaceutically acceptable carriers include one or more of water, saline, phosphate buffered saline, dextrose, glycerol, ethanol and the like, as well as combinations thereof. In some embodiments, isotonic agents, for example, sugars, polyalcohols such as mannitol, sorbitol, or sodium chloride, are included in the composition. Pharmaceutically acceptable carriers may further comprise minor amounts of auxiliary substances such as wetting or emulsifying agents, preservatives or buffers, which enhance the shelf life or effectiveness of the antibody or antibody portion.

Various delivery systems are known and can be used to administer one or more antibodies provided herein or the combination of one or more antibodies provided herein and a prophylactic agent or therapeutic agent useful for preventing, managing, treating, or ameliorating a disorder or one or more symptoms thereof, e.g., encapsulation in liposomes, microparticles, microcapsules, recombinant cells capable of expressing the antibody or antibody fragment, receptor-mediated endocytosis (see, e.g., Wu and Wu (1987) J. Biol. Chem. 262:4429-4432), construction of a nucleic acid as part of a retroviral or other vector, etc. Methods of administering a prophylactic or therapeutic agent provided herein include, but are not limited to, parenteral administration (e.g., intradermal, intramuscular, intraperitoneal, intravenous and subcutaneous), epidural administration, intratumoral administration, and mucosal administration (e.g., intranasal and oral routes). In addition, pulmonary administration can be employed, e.g., by use of an inhaler or nebulizer, and a formulation with an aerosolizing agent. See, e.g., U.S. Pat. Nos. 6,019,968; 5,985,320; 5,985,309; 5,934,272; 5,874,064; 5,855,913; 5,290,540; and 4,880,078; and PCT Publication Nos. WO 92/19244; WO 97/32572; WO 97/44013; WO 98/31346; and WO 99/66903. In one embodiment, a binding protein, combination therapy, or a composition provided herein is administered using Alkermes AIR® pulmonary drug delivery technology (Alkermes, Inc., Cambridge, Mass.). In a specific embodiment, prophylactic or therapeutic agents provided herein are administered intramuscularly, intravenously, intratumorally, orally, intranasally, pulmonary, or subcutaneously. The prophylactic or therapeutic agents may be administered by any convenient route, for example by infusion or bolus injection, by absorption through epithelial or mucocutaneous linings (e.g., oral mucosa, rectal and intestinal mucosa, etc.) and may be administered together with other biologically active agents. Administration can be systemic or local.

In an embodiment, specific binding of antibody-coupled carbon nanotubes (CNTs) to tumor cells in vitro, followed by their highly specific ablation with near-infrared (NIR) light can be used to target tumor cells. For example, biotinylated polar lipids can be used to prepare stable, biocompatible, noncytotoxic CNT dispersions that are then attached to one or two different neutralite avidin-derivatized DVD-Igs directed against one or more tumor antigens (e.g., CD22) (Chakravarty, P. et al. (2008) Proc. Natl. Acad. Sci. USA 105:8697-8702.

In a specific embodiment, it may be desirable to administer the prophylactic or therapeutic agents provided herein locally to the area in need of treatment; this may be achieved by, for example, and not by way of limitation, local infusion, by injection, or by means of an implant, said implant being of a porous or non-porous material, including membranes and matrices, such as sialastic membranes, polymers, fibrous matrices (e.g., Tissuel®), or collagen matrices. In one embodiment, an effective amount of one or more antibodies provided herein is administered locally to the affected area to a subject to prevent, treat, manage, and/or ameliorate a disorder or a symptom thereof. In another embodiment, an effective amount of one or more antibodies provided herein is administered locally to the affected area of a subject in combination with an effective amount of one or more therapies (e.g., one or more prophylactic or therapeutic agents) other than a binding protein provided herein to prevent, treat, manage, and/or ameliorate a disorder or one or more symptoms thereof.

In another embodiment, the prophylactic or therapeutic agent can be delivered in a controlled release or sustained release system. In one embodiment, a pump may be used to achieve controlled or sustained release (see Langer, supra; Sefton (1987) CRC Crit. Ref. Biomed. Eng. 14: 20; Buchwald et al. (1980) Surgery 88: 507; Saudek et al. (1989) N. Engl. J. Med. 321: 574). In another embodiment, polymeric materials can be used to achieve controlled or sustained release of the therapies of the present disclosure (see e.g., Medical Applications of Controlled Release, Langer and Wise (eds.), CRC Pres., Boca Raton, Fla. (1974); Controlled Drug Bioavailability, Drug Product Design and Performance, Smolen and Ball (eds.), Wiley, New York (1984); Ranger and Peppas (1983) J., Macromol. Sci. Rev. Macromol. Chem. 23:61; see also Levy et al. (1985) Science 228: 190; During et al. (1989) Ann. Neurol. 25: 351; Howard et al. (1989) J. Neurosurg. 71: 105); U.S. Pat. Nos. 5,679,377; 5,916,597; 5,912,015; 5,989,463; and 5,128,326; and PCT Publication Nos. WO 99/15154; WO 99/20253. Examples of polymers used in sustained release formulations include, but are not limited to, poly(2-hydroxy ethyl methacrylate), poly(methyl methacrylate), poly(acrylic acid), poly(ethylene-co-vinyl acetate), poly(methacrylic acid), polyglycolides (PLG), polyanhydrides, poly(N-vinyl pyrrolidone), poly(vinyl alcohol), polyacrylamide, poly(ethylene glycol), polylactides (PLA), poly(lactide-co-glycolides) (PLGA), and polyorthoesters. In an embodiment, the polymer used in a sustained release formulation is inert, free of leachable impurities, stable on storage, sterile, and biodegradable. In yet another embodiment, a controlled or sustained release system can be placed in proximity of the prophylactic or therapeutic target, thus requiring only a fraction of the systemic dose (see, e.g., Goodson, in Medical Applications of Controlled Release, supra, vol. 2, pp. 115-138 (1984)).

Controlled release systems are discussed in the review by Langer (1990) Science 249: 1527-1533). Any technique known to one of skill in the art can be used to produce sustained release formulations comprising one or more therapeutic agents of the present disclosure. See, e.g., U.S. Pat. No. 4,526,938; PCT Publication Nos. WO 91/05548; WO 96/20698, Ning et al. (1996) Radiotherap. Oncol. 39: 179-189; Song et al. (1995) PDA J. Pharma. Sci. Tech. 50:372-397; Cleek et al. (1997) Pro. Intl Symp. Control. Rel. Bioact. Mater. 24: 853-854, and Lam et al. (1997) Proc. Intl Symp. Control Rel. Bioact. Mater. 24:759-760.

In a specific embodiment, where the composition is a nucleic acid encoding a prophylactic or therapeutic agent, the nucleic acid can be administered in vivo to promote expression of its encoded prophylactic or therapeutic agent, by constructing it as part of an appropriate nucleic acid expression vector and administering it so that it becomes intracellular, e.g., by use of a retroviral vector (see U.S. Pat. No. 4,980,286), or by direct injection, or by use of microparticle bombardment (e.g., a gene gun; Biolistic, Dupont), or coating with lipids or cell-surface receptors or transfecting agents, or by administering it in linkage to a homeobox-like peptide which is known to enter the nucleus (see, e.g., Joliot et al. (1991) Proc. Natl. Acad. Sci. USA 88:1864-1868). Alternatively, a nucleic acid can be introduced intracellularly and incorporated within host cell DNA for expression by homologous recombination.

A pharmaceutical composition provided herein may be formulated to be compatible with its intended route of administration. Examples of routes of administration include, but are not limited to, parenteral, e.g., intravenous, intradermal, subcutaneous, oral, intranasal (e.g., inhalation), transdermal (e.g., topical), transmucosal, and rectal administration. In a specific embodiment, the composition is formulated in accordance with routine procedures as a pharmaceutical composition adapted for intravenous, subcutaneous, intramuscular, oral, intranasal, or topical administration to human beings. Typically, compositions for intravenous administration are solutions in sterile isotonic aqueous buffer. Where necessary, the composition may also include a solubilizing agent and a local anesthetic such as lignocamne to ease pain at the site of the injection.

If the compositions are to be administered topically, the compositions can be formulated in the form of an ointment, cream, transdermal patch, lotion, gel, shampoo, spray, aerosol, solution, emulsion, or other form well-known to one of skill in the art. See, e.g., Remington's Pharmaceutical Sciences and Introduction to Pharmaceutical Dosage Forms, 19th ed., Mack Pub. Co., Easton, Pa. (1995). In an embodiment, for non-sprayable topical dosage forms, viscous to semi-solid or solid forms comprising a carrier or one or more excipients compatible with topical application and having a dynamic viscosity greater than water are employed. Suitable formulations include, without limitation, solutions, suspensions, emulsions, creams, ointments, powders, liniments, salves, and the like, which are, if desired, sterilized or mixed with auxiliary agents (e.g., preservatives, stabilizers, wetting agents, buffers, or salts) for influencing various properties, such as, for example, osmotic pressure. Other suitable topical dosage forms include sprayable aerosol preparations wherein the active ingredient, in an embodiment, in combination with a solid or liquid inert carrier, is packaged in a mixture with a pressurized volatile (e.g., a gaseous propellant, such as freon) or in a squeeze bottle. Moisturizers or humectants can also be added to pharmaceutical compositions and dosage forms if desired. Examples of such additional ingredients are well-known in the art.

If the method comprises intranasal administration of a composition, the composition can be formulated in an aerosol form, spray, mist or in the form of drops. In particular, prophylactic or therapeutic agents can be conveniently delivered in the form of an aerosol spray presentation from pressurized packs or a nebuliser, with the use of a suitable propellant (e.g., dichlorodifluoromethane, trichlorofluoromethane, dichlorotetrafluoroethane, carbon dioxide or other suitable gas). In the case of a pressurized aerosol the dosage unit may be determined by providing a valve to deliver a metered amount. Capsules and cartridges (composed of, e.g., gelatin) for use in an inhaler or insufflator may be formulated containing a powder mix of the compound and a suitable powder base such as lactose or starch.

If the method comprises oral administration, compositions can be formulated orally in the form of tablets, capsules, cachets, gelcaps, solutions, suspensions, and the like. Tablets or capsules can be prepared by conventional means with pharmaceutically acceptable excipients such as binding agents (e.g., pregelatinised maize starch, polyvinylpyrrolidone, or hydroxypropyl methylcellulose); fillers (e.g., lactose, microcrystalline cellulose, or calcium hydrogen phosphate); lubricants (e.g., magnesium stearate, talc, or silica); disintegrants (e.g., potato starch or sodium starch glycolate); or wetting agents (e.g., sodium lauryl sulphate). The tablets may be coated by methods well-known in the art. Liquid preparations for oral administration may take the form of, but not limited to, solutions, syrups or suspensions, or they may be presented as a dry product for constitution with water or other suitable vehicle before use. Such liquid preparations may be prepared by conventional means with pharmaceutically acceptable additives such as suspending agents (e.g., sorbitol syrup, cellulose derivatives, or hydrogenated edible fats); emulsifying agents (e.g., lecithin or acacia); non-aqueous vehicles (e.g., almond oil, oily esters, ethyl alcohol, or fractionated vegetable oils); and preservatives (e.g., methyl or propyl-p-hydroxybenzoates or sorbic acid). The preparations may also contain buffer salts, flavoring, coloring, and sweetening agents as appropriate. Preparations for oral administration may be suitably formulated for slow release, controlled release, or sustained release of a prophylactic or therapeutic agent(s).

The method provided herein may comprise pulmonary administration, e.g., by use of an inhaler or nebulizer, of a composition formulated with an aerosolizing agent. See, e.g., U.S. Pat. Nos. 6,019,968; 5,985,320; 5,985,309; 5,934,272; 5,874,064; 5,855,913; 5,290,540; and 4,880,078; and PCT Publication Nos. WO 92/19244; WO 97/32572; WO 97/44013; WO 98/31346; and WO 99/66903. In a specific embodiment, a binding protein, combination therapy, and/or composition provided herein is administered using Alkermes AIR® pulmonary drug delivery technology (Alkermes, Inc., Cambridge, Mass.).

The method may comprise administration of a composition formulated for parenteral administration by injection (e.g., by bolus injection or continuous infusion). Formulations for injection may be presented in unit dosage form (e.g., in ampoules or in multi-dose containers) with an added preservative. The compositions may take such forms as suspensions, solutions or emulsions in oily or aqueous vehicles, and may contain formulatory agents such as suspending, stabilizing and/or dispersing agents. Alternatively, the active ingredient may be in powder form for constitution with a suitable vehicle (e.g., sterile pyrogen-free water) before use.

The methods may additionally comprise of administration of compositions formulated as depot preparations. Such long acting formulations may be administered by implantation (e.g., subcutaneously or intramuscularly) or by intramuscular injection. Thus, for example, the compositions may be formulated with suitable polymeric or hydrophobic materials (e.g., as an emulsion in an acceptable oil) or ion exchange resins, or as sparingly soluble derivatives (e.g., as a sparingly soluble salt).

The methods provided herein encompass administration of compositions formulated as neutral or salt forms. Pharmaceutically acceptable salts include those formed with anions such as those derived from hydrochloric, phosphoric, acetic, oxalic, tartaric acids, etc., and those formed with cations such as those derived from sodium, potassium, ammonium, calcium, ferric hydroxides, isopropylamine, triethylamine, 2-ethylamino ethanol, histidine, procaine, etc.

Generally, the ingredients of compositions are supplied either separately or mixed together in unit dosage form, for example, as a dry lyophilized powder or water free concentrate in a hermetically sealed container such as an ampoule or sachette indicating the quantity of active agent. Where the mode of administration is infusion, composition can be dispensed with an infusion bottle containing sterile pharmaceutical grade water or saline. Where the mode of administration is by injection, an ampoule of sterile water for injection or saline can be provided so that the ingredients may be mixed prior to administration.

One or more of the prophylactic or therapeutic agents, or pharmaceutical compositions provided herein may be packaged in a hermetically sealed container such as an ampoule or sachette indicating the quantity of the agent. In one embodiment, one or more of the prophylactic or therapeutic agents, or pharmaceutical compositions provided herein is supplied as a dry sterilized lyophilized powder or water free concentrate in a hermetically sealed container and can be reconstituted (e.g., with water or saline) to the appropriate concentration for administration to a subject. In an embodiment, one or more of the prophylactic or therapeutic agents or pharmaceutical compositions provided herein is supplied as a dry sterile lyophilized powder in a hermetically sealed container at a unit dosage of at least 5 mg, at least 10 mg, at least 15 mg, at least 25 mg, at least 35 mg, at least 45 mg, at least 50 mg, at least 75 mg, or at least 100 mg. The lyophilized prophylactic or therapeutic agents or pharmaceutical compositions provided herein should be stored at between 2° C. and 8° C. in its original container and the prophylactic or therapeutic agents, or pharmaceutical compositions provided herein should be administered within 1 week, e.g., within 5 days, within 72 hours, within 48 hours, within 24 hours, within 12 hours, within 6 hours, within 5 hours, within 3 hours, or within 1 hour after being reconstituted. In an alternative embodiment, one or more of the prophylactic or therapeutic agents or pharmaceutical compositions provided herein is supplied in liquid form in a hermetically sealed container indicating the quantity and concentration of the agent. In an embodiment, the liquid form of the administered composition is supplied in a hermetically sealed container at least 0.25 mg/ml, at least 0.5 mg/ml, at least 1 mg/ml, at least 2.5 mg/ml, at least 5 mg/ml, at least 8 mg/ml, at least 10 mg/ml, at least 15 mg/kg, at least 25 mg/ml, at least 50 mg/ml, at least 75 mg/ml or at least 100 mg/ml. The liquid form should be stored at between 2° C. and 8° C. in its original container.

The binding proteins provided herein can be incorporated into a pharmaceutical composition suitable for parenteral administration. In an embodiment, the antibody or antibody-portions will be prepared as an injectable solution containing 0.1-250 mg/ml binding protein. The injectable solution can be composed of either a liquid or lyophilized dosage form in a flint or amber vial, ampule or pre-filled syringe. The buffer can be L-histidine (1-50 mM), optimally 5-10 mM, at pH 5.0 to 7.0 (optimally pH 6.0). Other suitable buffers include but are not limited to, sodium succinate, sodium citrate, sodium phosphate or potassium phosphate. Sodium chloride can be used to modify the toxicity of the solution at a concentration of 0-300 mM (optimally 150 mM for a liquid dosage form). Cryoprotectants can be included for a lyophilized dosage form, principally 0-10% sucrose (optimally 0.5-1.0%). Other suitable cryoprotectants include trehalose and lactose. Other suitable bulking agents include glycine and arginine, either of which can be included at a concentration of 0-0.05%, and polysorbate-80 (optimally included at a concentration of 0.005-0.01%). Additional surfactants include but are not limited to polysorbate 20 and BRIJ surfactants. The pharmaceutical composition comprising the binding proteins provided herein prepared as an injectable solution for parenteral administration, can further comprise an agent useful as an adjuvant, such as those used to increase the absorption, or dispersion of a therapeutic protein (e.g., antibody). A particularly useful adjuvant is hyaluronidase, such as Hylenex® (recombinant human hyaluronidase). Addition of hyaluronidase in the injectable solution improves human bioavailability following parenteral administration, particularly subcutaneous administration. It also allows for greater injection site volumes (i.e., greater than 1 ml) with less pain and discomfort, and minimum incidence of injection site reactions (see PCT Publication No. WO 2004/078140, and U.S. Patent Publication No. 2006/104968).

The compositions provided herein may be in a variety of forms. These include, for example, liquid, semi-solid and solid dosage forms, such as liquid solutions (e.g., injectable and infusible solutions), dispersions or suspensions, tablets, pills, powders, liposomes and suppositories. The form chosen depends on the intended mode of administration and therapeutic application. Typical compositions are in the form of injectable or infusible solutions, such as compositions similar to those used for passive immunization of humans with other antibodies. The chosen mode of administration is parenteral (e.g., intravenous, subcutaneous, intraperitoneal, intramuscular). In an embodiment, the antibody is administered by intravenous infusion or injection. In another embodiment, the antibody is administered by intramuscular or subcutaneous injection.

Therapeutic compositions typically must be sterile and stable under the conditions of manufacture and storage. The composition can be formulated as a solution, microemulsion, dispersion, liposome, or other ordered structure suitable to high drug concentration. Sterile injectable solutions can be prepared by incorporating the active compound (i.e., antibody or antibody portion) in the required amount in an appropriate solvent with one or a combination of ingredients enumerated herein, as required, followed by filtered sterilization. Generally, dispersions are prepared by incorporating the active compound into a sterile vehicle that contains a basic dispersion medium and the required other ingredients from those enumerated herein. In the case of sterile, lyophilized powders for the preparation of sterile injectable solutions, the methods of preparation are vacuum drying and spray-drying that yields a powder of the active ingredient plus any additional desired ingredient from a previously sterile-filtered solution thereof. The proper fluidity of a solution can be maintained, for example, by the use of a coating such as lecithin, by the maintenance of the required particle size in the case of dispersion and by the use of surfactants. Prolonged absorption of injectable compositions can be brought about by including, in the composition, an agent that delays absorption, for example, monostearate salts and gelatin.

The binding proteins provided herein can be administered by a variety of methods known in the art, although for many therapeutic applications, in an embodiment, the route/mode of administration is subcutaneous injection, intravenous injection or infusion. As will be appreciated by the skilled artisan, the route and/or mode of administration will vary depending upon the desired results. In certain embodiments, the active compound may be prepared with a carrier that will protect the compound against rapid release, such as a controlled release formulation, including implants, transdermal patches, and microencapsulated delivery systems. Biodegradable, biocompatible polymers can be used, such as ethylene vinyl acetate, polyanhydrides, polyglycolic acid, collagen, polyorthoesters, and polylactic acid. Many methods for the preparation of such formulations are patented or generally known to those skilled in the art. See, e.g., Sustained and Controlled Release Drug Delivery Systems, J. R. Robinson, ed., Marcel Dekker, Inc., New York, 1978.

In certain embodiments, a binding protein provided herein may be orally administered, for example, with an inert diluent or an assimilable edible carrier. The compound (and other ingredients, if desired) may also be enclosed in a hard or soft shell gelatin capsule, compressed into tablets, or incorporated directly into the subject's diet. For oral therapeutic administration, the compounds may be incorporated with excipients and used in the form of ingestible tablets, buccal tablets, troches, capsules, elixirs, suspensions, syrups, wafers, and the like. To administer a compound by other than parenteral administration, it may be necessary to coat the compound with, or co-administer the compound with, a material to prevent its inactivation.

Supplementary active compounds can also be incorporated into the compositions. In certain embodiments, a binding protein provided herein is coformulated with and/or coadministered with one or more additional therapeutic agents that are useful for treating disorders with a binding protein provided herein. For example, a binding protein provided herein may be coformulated and/or coadministered with one or more additional antibodies that bind other targets (e.g., antibodies that bind other cytokines or that bind cell surface molecules). Furthermore, one or more antibodies provided herein may be used in combination with two or more of the foregoing therapeutic agents. Such combination therapies may advantageously utilize lower dosages of the administered therapeutic agents, thus avoiding possible toxicities or complications associated with the various monotherapies.

In certain embodiments, a binding protein is linked to a half-life extending vehicle known in the art. Such vehicles include, but are not limited to, the Fc domain, polyethylene glycol, and dextran. Such vehicles are described, e.g., in U.S. Pat. No. 6,660,843 and published PCT Publication No. WO 99/25044.

In a specific embodiment, nucleic acid sequences encoding a binding protein provided herein or another prophylactic or therapeutic agent are administered to treat, prevent, manage, or ameliorate a disorder or one or more symptoms thereof by way of gene therapy. Gene therapy refers to therapy performed by the administration to a subject of an expressed or expressible nucleic acid. In this embodiment, the nucleic acids produce their encoded antibody or prophylactic or therapeutic agent that mediates a prophylactic or therapeutic effect.

Any of the methods for gene therapy available in the art can be used. For general reviews of the methods of gene therapy, see Goldspiel et al. (1993) Clinical Pharmacy 12:488-505; Wu and Wu (1991) Biotherapy 3:87-95; Tolstoshev (1993) Ann. Rev. Pharmacol. Toxicol. 32:573-596; Mulligan (1993) Science 260:926-932; and Morgan and Anderson (1993) Ann. Rev. Biochem. 62:191-217; May (1993) TIBTECH 11(5):155-215. Methods commonly known in the art of recombinant DNA technology which can be used are described in Ausubel et al. (eds.), Current Protocols in Molecular Biology, John Wiley &Sons, NY (1993); and Kriegler, Gene Transfer and Expression, A Laboratory Manual, Stockton Press, NY (1990). Detailed descriptions of various methods of gene therapy are disclosed in U.S. Patent Publication No. 20090297514.

The binding proteins provided herein are useful in treating various diseases wherein the targets that are recognized by the binding proteins are detrimental. Such diseases include, but are not limited to, rheumatoid arthritis, osteoarthritis, juvenile chronic arthritis, septic arthritis, Lyme arthritis, psoriatic arthritis, reactive arthritis, spondyloarthropathy, systemic lupus erythematosus, Crohn's disease, ulcerative colitis, inflammatory bowel disease, insulin dependent diabetes mellitus, thyroiditis, asthma, allergic diseases, psoriasis, dermatitis scleroderma, graft versus host disease, organ transplant rejection, acute or chronic immune disease associated with organ transplantation, sarcoidosis, atherosclerosis, disseminated intravascular coagulation, Kawasaki's disease, Grave's disease, nephrotic syndrome, chronic fatigue syndrome, Wegener's granulomatosis, Henoch-Schoenlein purpurea, microscopic vasculitis of the kidneys, chronic active hepatitis, uveitis, septic shock, toxic shock syndrome, sepsis syndrome, cachexia, infectious diseases, parasitic diseases, acquired immunodeficiency syndrome, acute transverse myelitis, Huntington's chorea, Parkinson's disease, Alzheimer's disease, stroke, primary biliary cirrhosis, hemolytic anemia, malignancies, heart failure, myocardial infarction, Addison's disease, sporadic, polyglandular deficiency type I and polyglandular deficiency type II, Schmidt's syndrome, adult (acute) respiratory distress syndrome, alopecia, alopecia areata, seronegative arthopathy, arthropathy, Reiter's disease, psoriatic arthropathy, ulcerative colitic arthropathy, enteropathic synovitis, chlamydia, *yersinia* and *salmonella* associated arthropathy, spondyloarthopathy, atheromatous disease/arteriosclerosis, atopic allergy, autoimmune bullous disease, pemphigus vulgaris, pemphigus foliaceus, pemphigoid, linear IgA disease, autoimmune haemolytic anaemia, Coombs positive haemolytic anaemia, acquired pernicious anaemia, juvenile pernicious anaemia, myalgic encephalitis/Royal Free Disease, chronic mucocutaneous candidiasis, giant cell arteritis, primary sclerosing hepatitis, cryptogenic autoimmune hepatitis, Acquired Immunodeficiency Disease Syndrome, Acquired Immunodeficiency Related Diseases, Hepatitis B, Hepatitis C, common varied immunodeficiency (common variable hypogammaglobulinaemia), dilated cardiomyopathy, female infertility, ovarian failure, premature ovarian failure, fibrotic lung disease, cryptogenic fibrosing alveolitis, post-inflammatory interstitial lung disease, interstitial pneumonitis, connective tissue disease associated interstitial lung disease, mixed connective tissue disease associated lung disease, systemic sclerosis associated interstitial lung disease, rheumatoid arthritis associated interstitial lung disease, systemic lupus erythematosus associated lung disease, dermatomyositis/polymyositis associated lung disease, Sjögren's disease associated lung disease, ankylosing spondylitis associated lung disease, vasculitic diffuse lung disease, haemosiderosis associated lung disease, drug-induced interstitial lung disease, fibrosis, radiation fibrosis, bronchiolitis obliterans, chronic eosinophilic pneumonia, lymphocytic infiltrative lung disease, postinfectious interstitial lung disease, gouty arthritis, autoimmune hepatitis, type-1 autoimmune hepatitis (classical autoimmune or lupoid hepatitis), type-2 autoimmune hepatitis (anti-LKM antibody hepatitis), autoimmune mediated hypoglycaemia, type B insulin resistance with acanthosis nigricans, hypoparathyroidism, acute immune disease associated with organ transplantation, chronic immune disease associated with organ transplantation, osteoarthrosis, primary sclerosing cholangitis, psoriasis type 1, psoriasis type 2, idiopathic leucopaenia, autoimmune neutropaenia, renal disease NOS, glomerulonephritides, microscopic vasulitis of the kidneys, lyme disease, discoid lupus erythematosus, male infertility idiopathic or NOS, sperm autoimmunity, multiple sclerosis (all subtypes), sympathetic ophthalmia, pulmonary hypertension secondary to connective tissue disease, Goodpasture's syndrome, pulmonary manifestation of polyarteritis nodosa, acute rheumatic fever, rheumatoid spondylitis, Still's disease, systemic sclerosis, Sjörgren's syndrome, Takayasu's disease/arteritis, autoimmune thrombocytopaenia, idiopathic thrombocytopaenia, autoimmune thyroid disease, hyperthyroidism, goitrous autoimmune hypothyroidism (Hashimoto's disease), atrophic autoimmune hypothyroidism, primary myxoedema, phacogenic uveitis, primary vasculitis, vitiligo acute liver disease, chronic liver diseases, alcoholic cirrhosis, alcohol-induced liver injury, choleosatatis, idiosyncratic liver disease, Drug-Induced hepatitis, Non-alcoholic Steatohepatitis, allergy and asthma, group B streptococci (GBS) infection, mental disorders (e.g., depression and schizophrenia), Th2 Type and Th1 Type mediated diseases, acute and chronic pain (different forms of pain), and cancers such as lung, breast, stomach, bladder, colon, pancreas, ovarian, prostate and rectal cancer and hematopoietic malignancies (leukemia and lymphoma), Abetalipoprotemia, Acrocyanosis, acute and chronic parasitic or infectious processes, acute leukemia, acute lymphoblastic leukemia (ALL), acute myeloid leukemia (AML), acute or chronic bacterial infection, acute pancreatitis, acute renal failure, adenocarcinomas, aerial ectopic beats, AIDS dementia complex, alcohol-induced hepatitis, allergic conjunctivitis, allergic contact dermatitis, allergic rhinitis, allograft rejection, alpha-l-antitrypsin deficiency, amyotrophic lateral sclerosis, anemia, angina pectoris, anterior horn cell degeneration, anti cd3 therapy, antiphospholipid syndrome, anti-receptor hypersensitivity reactions, aordic and peripheral aneuryisms, aortic dissection, arterial hypertension, arteriosclerosis, arteriovenous fistula, ataxia, atrial fibrillation (sustained or paroxysmal), atrial flutter, atrioventricular block, B cell lymphoma, bone graft rejection, bone marrow transplant (BMT) rejection, bundle branch block, Burkitt's lymphoma, Burns, cardiac arrhythmias, cardiac stun syndrome, cardiac tumors, cardiomyopathy, cardiopulmonary bypass inflammation response, cartilage transplant rejection, cerebellar cortical degenerations, cerebellar disorders, chaotic or multifocal atrial tachycardia, chemotherapy associated disorders, chromic myelocytic leukemia (CML), chronic alcoholism, chronic inflammatory pathologies, chronic lymphocytic leukemia (CLL), chronic obstructive pulmonary disease (COPD), chronic salicylate intoxication, colorectal carcinoma, congestive heart failure, conjunctivitis, contact dermatitis, cor pulmonale, coronary artery disease, Creutzfeldt-Jakob disease, culture negative sepsis, cystic fibrosis, cytokine therapy associated disorders, Dementia pugilistica, demyelinating diseases, dengue hemorrhagic fever, dermatitis, dermatologic conditions, diabetes, diabetes mellitus, diabetic ateriosclerotic disease, Diffuse Lewy body disease, dilated congestive cardiomyopathy, disorders of the basal ganglia, Down's Syndrome in middle age, drug-induced movement disorders induced by drugs which block CNS dopamine receptors, drug sensitivity, eczema, encephalomyelitis, endocarditis, endocrinopathy, epiglottitis, epstein-barr virus infection, erythromelalgia, extrapyramidal and cerebellar disorders, familial hematophagocytic lymphohistiocytosis, fetal thymus implant rejection, Friedreich's ataxia, functional peripheral arterial disorders, fungal sepsis, gas gangrene, gastric ulcer, glomerular nephritis, graft rejection of any organ or tissue, gram negative sepsis, gram positive sepsis, granulomas due to intracellular organisms, hairy cell leukemia, Hallerrorden-Spatz disease, hashimoto's thyroiditis, hay fever, heart transplant rejection, hemachromatosis, hemodialysis, hemolytic uremic syndrome/thrombolytic thrombocytopenic purpura, hemorrhage, hepatitis (A), His bundle arrythmias, HIV infection/HIV neuropathy, Hodgkin's disease, hyperkinetic movement disorders, hypersensitivity reactions, hypersensitivity pneumonitis, hypertension, hypokinetic movement disorders, hypothalamic-pituitaryadrenal axis evaluation, idiopathic Addison's disease, idiopathic pulmonary fibrosis, antibody mediated cytotoxicity, Asthenia, infantile spinal muscular atrophy, inflammation of the aorta, influenza a, ionizing radiation exposure, iridocyclitis/uveitis/optic neuritis, ischemia-reperfusion injury, ischemic stroke, juvenile rheumatoid arthritis, juvenile spinal muscular atrophy, Kaposi's sarcoma, kidney transplant rejection, *legionella*, leishmaniasis, leprosy, lesions of the corticospinal system, lipedema, liver transplant rejection, lymphederma, malaria, malignant Lymphoma, malignant histiocytosis, malignant melanoma, meningitis, meningococcemia, metabolic/idiopathic, migraine headache, mitochondrial multi.system disorder, mixed connective tissue disease, monoclonal gammopathy, multiple myeloma, multiple systems degenerations (Mencel Dejerine-Thomas Shi-Drager and Machado-Joseph), myasthenia gravis, *mycobacterium avium* intracellulare, *mycobacterium tuberculosis*, myelodyplastic syndrome, myocardial infarction, myocardial ischemic disorders, nasopharyngeal carcinoma, neonatal chronic lung disease, nephritis, nephrosis, neurodegenerative diseases, neurogenic I muscular atrophies, neutropenic fever, non-hodgkins lymphoma, occlusion of the abdominal aorta and its branches, occlusive arterial disorders, okt3 therapy, orchitis/epidydimitis, orchitis/vasectomy reversal procedures, organomegaly, osteoporosis, pancreas transplant rejection, pancreatic carcinoma, paraneoplastic syndrome/hypercalcemia of malignancy, parathyroid transplant rejection, pelvic inflammatory disease, perennial rhinitis, pericardial disease, peripheral atherlosclerotic disease, peripheral vascular disorders, peritonitis, pernicious anemia, *pneumocystis carinii* pneumonia, pneumonia, POEMS syndrome (polyneuropathy, organomegaly, endocrinopathy, monoclonal gammopathy, and skin changes syndrome), post perfusion syndrome, post pump syndrome, post-MI cardiotomy syndrome, preeclampsia, Progressive supranucleo Palsy, primary pulmonary hypertension, radiation therapy, Raynaud's phenomenon and disease, Raynaud's disease, Refsum's disease, regular narrow QRS tachycardia, renovascular hypertension, reperfusion injury, restrictive cardiomyopathy, sarcomas, scleroderma, senile chorea, Senile Dementia of Lewy body type, seronegative arthropathies, shock, sickle cell anemia, skin allograft rejection, skin changes syndrome, small bowel transplant rejection, solid tumors, specific arrythmias, spinal ataxia, spinocerebellar degenerations, streptococcal myositis, structural lesions of the cerebellum, Subacute sclerosing panencephalitis, Syncope, syphilis of the cardiovascular system, systemic anaphalaxis, systemic inflammatory response syndrome, systemic onset juvenile rheumatoid arthritis, T-cell or FAB ALL, Telangiectasia, thromboangitis obliterans, thrombocytopenia, toxicity, transplants, trauma/hemorrhage, type III hypersensitivity reactions, type IV hypersensitivity, unstable angina, uremia, urosepsis, urticaria, valvular heart diseases, varicose veins, vasculitis, venous diseases, venous thrombosis, ventricular fibrillation, viral and fungal infections, vital encephalitis/aseptic meningitis, vital-associated hemaphagocytic syndrome, Wernicke-Korsakoff syndrome, Wilson's disease, xenograft rejection of any organ or tissue. (see PCT Publication Nos. WO 2002/097048; WO 95/24918; and WO 00/56772).

The DVD-Igs provided herein may also treat one or more of the following diseases: Acute coronary syndromes, Acute Idiopathic Polyneuritis, Acute Inflammatory Demyelinating Polyradiculoneuropathy, Acute ischemia, Adult Still's Disease, Alopecia areata, Anaphylaxis, Anti-Phospholipid Antibody Syndrome, Aplastic anemia, Arteriosclerosis, Atopic eczema, Atopic dermatitis, Autoimmune dermatitis, Autoimmune disorder associated with *Streptococcus* infection, Autoimmune hearing loss, Autoimmune Lymphoproliferative Syndrome (ALPS), Autoimmune myocarditis, autoimmune thrombocytopenia (AITP), Blepharitis, Bronchiectasis, Bullous pemphigoid, Cardiovascular Disease, Catastrophic Antiphospholipid Syndrome, Celiac Disease, Cervical Spondylosis, Chronic ischemia, Cicatricial pemphigoid, Clinically isolated Syndrome (CIS) with Risk for Multiple Sclerosis, Conjunctivitis, Childhood Onset Psychiatric Disorder, Chronic obstructive pulmonary disease (COPD), Dacryocystitis, dermatomyositis, Diabetic retinopathy, Diabetes mellitus, Disk herniation, Disk prolaps, Drug induced immune hemolytic anemia, Endocarditis, Endometriosis, endophthalmitis, Erythema multiforme, erythema multiforme major, Gestational pemphigoid, Guillain-Barré Syndrome (GBS), Hay Fever, Hughes Syndrome, Idiopathic Parkinson's Disease, idiopathic interstitial pneumonia, IgE-mediated Allergy, Immune hemolytic anemia, Inclusion Body Myositis, Infectious ocular inflammatory disease, Inflammatory demyelinating disease, Inflammatory heart disease, Inflammatory kidney disease, IPF/UIP, Iritis, Keratitis, Keratojuntivitis sicca, Kussmaul disease or Kussmaul-Meier Disease, Landry's Paralysis, Langerhan's Cell Histiocytosis, Livedo reticularis, Macular Degeneration, malignancies, Microscopic Polyangiitis, Morbus Bechterev, Motor Neuron Disorders, Mucous membrane pemphigoid, Multiple Organ failure, Myasthenia Gravis, Myelodysplastic Syndrome, Myocarditis, Nerve Root Disorders, Neuropathy, Non-A Non-B Hepatitis, Optic Neuritis, Osteolysis, Ovarian cancer, Pauciarticular JRA, peripheral artery occlusive disease (PAOD), peripheral vascular disease (PVD), peripheral artery disease (PAD), Phlebitis, Polyarteritis nodosa (or periarteritis nodosa), Polychondritis, Polymyalgia Rheumatica, Poliosis, Polyarticular JRA, Polyendocrine Deficiency Syndrome, Polymyositis, polymyalgia rheumatica (PMR), Post-Pump Syndrome, primary parkinsonism, prostate and rectal cancer and hematopoietic malignancies (leukemia and lymphoma), Prostatitis, Pure red cell aplasia, Primary Adrenal Insufficiency, Recurrent Neuromyelitis Optica, Restenosis, Rheumatic heart disease, SAPHO (synovitis, acne, pustulosis, hyperostosis, and osteitis), Scleroderma, Secondary Amyloidosis, Shock lung, Scleritis, Sciatica, Secondary Adrenal Insufficiency, Silicone associated connective tissue disease, Sneddon-Wilkinson Dermatosis, spondilitis ankylosans, Stevens-Johnson Syndrome (SJS), Systemic inflammatory response syndrome, Temporal arteritis, toxoplasmic retinitis, toxic epidermal necrolysis, Transverse myelitis, TRAPS (Tumor Necrosis Factor Receptor, Type 1 allergic reaction, Type II Diabetes, Urticaria, Usual interstitial pneumonia (UIP), Vasculitis, Vernal conjunctivitis, viral retinitis, Vogt-Koyanagi-Harada syndrome (VKH syndrome), Wet macular degeneration, and Wound healing.

The binding proteins provided herein can be used to treat humans suffering from autoimmune diseases, in particular those associated with inflammation, including, rheumatoid arthritis, spondylitis, allergy, autoimmune diabetes, autoimmune uveitis. In an embodiment, the binding proteins or antigen-binding portions thereof, are used to treat rheumatoid arthritis, Crohn's disease, multiple sclerosis, insulin dependent diabetes mellitus and psoriasis.

In an embodiment, diseases that can be treated or diagnosed with the compositions and methods provided herein include, but are not limited to, primary and metastatic cancers, including carcinomas of breast, colon, rectum, lung, oropharynx, hypopharynx, esophagus, stomach, pancreas, liver, gallbladder and bile ducts, small intestine, urinary tract (including kidney, bladder and urothelium), female genital tract (including cervix, uterus, and ovaries as well as choriocarcinoma and gestational trophoblastic disease), male genital tract (including prostate, seminal vesicles, testes and germ cell tumors), endocrine glands (including the thyroid, adrenal, and pituitary glands), and skin, as well as hemangiomas, melanomas, sarcomas (including those arising from bone and soft tissues as well as Kaposi's sarcoma), tumors of the brain, nerves, eyes, and meninges (including astrocytomas, gliomas, glioblastomas, retinoblastomas, neuromas, neuroblastomas, Schwannomas, and meningiomas), solid tumors arising from hematopoietic malignancies such as leukemias, and lymphomas (both Hodgkin's and non-Hodgkin's lymphomas).

In an embodiment, the antibodies provided herein, or antigen-binding portions thereof, are used to treat cancer, prevention, or inhibit metastases from the tumors described herein either when used alone or in combination with radiotherapy and/or other chemotherapeutic agents.

The antibodies provided herein, or antigen binding portions thereof, may be combined with agents that include but are not limited to, antineoplastic agents, radiotherapy, chemotherapy such as DNA alkylating agents, cisplatin, carboplatin, anti-tubulin agents, paclitaxel, docetaxel, taxol, doxorubicin, gemcitabine, gemzar, anthracyclines, adriamycin, topoisomerase I inhibitors, topoisomerase II inhibitors, 5-fluorouracil (5-FU), leucovorin, irinotecan, receptor tyrosine kinase inhibitors (e.g., erlotinib, gefitinib), COX-2 inhibitors (e.g., celecoxib), kinase inhibitors, and siRNAs.

A binding protein also can be administered with one or more additional therapeutic agents useful in the treatment of various diseases.

A binding protein provided herein can be used alone or in combination to treat such diseases. It should be understood that the binding proteins can be used alone or in combination with an additional agent, e.g., a therapeutic agent, said additional agent being selected by the skilled artisan for its intended purpose. For example, the additional agent can be a therapeutic agent art-recognized as being useful to treat the disease or condition being treated by the antibody. The additional agent also can be an agent that imparts a beneficial attribute to the therapeutic composition e.g., an agent which affects the viscosity of the composition.

It should further be understood that the combinations include those combinations useful for their intended purpose. The agents set forth below are illustrative and are not intended to be limited. The combinations can be the antibodies provided herein and at least one additional agent selected from the lists below. The combination can also include more than one additional agent, e.g., two or three additional agents if the combination is such that the formed composition can perform its intended function.

Combinations to treat autoimmune and inflammatory diseases are non-steroidal anti-inflammatory drug(s) also referred to as NSAIDS which include drugs like ibuprofen. Other combinations are corticosteroids including prednisolone; the well known side-effects of steroid use can be reduced or even eliminated by tapering the steroid dose required when treating patients in combination with the DVD Igs provided herein. Non-limiting examples of therapeutic agents for rheumatoid arthritis with which an antibody, or antibody portion, provided herein can be combined include the following: cytokine suppressive anti-inflammatory drug(s) (CSAIDs); antibodies to or antagonists of other human cytokines or growth factors, for example, TNF, LT, IL-1, IL-2, IL-3, IL-4, IL-5, IL-6, IL-7, IL-8, IL-15, IL-16, IL-18, IL-21, IL-23, interferons, EMAP-II, GM-CSF, FGF, and PDGF. Binding proteins provided herein, or antigen binding portions thereof, can be combined with antibodies to cell surface molecules such as CD2, CD3, CD4, CD8, CD25, CD28, CD30, CD40, CD45, CD69, CD80 (B7.1), CD86 (B7.2), CD90, and CTLA or their ligands including CD154 (gp39 or CD40L).

Combinations of therapeutic agents may interfere at different points in the autoimmune and subsequent inflammatory cascade; examples include TNF antagonists like chimeric, humanized or human TNF antibodies, ADALIMUMAB, (PCT Publication No. WO 97/29131), CA2 (Remicade™), CDP 571, and soluble p55 or p75 TNF receptors, derivatives, thereof, (p75TNFR1gG (Enbrel™) or p55TNFR1gG (Lenercept), and also TNFα converting enzyme (TACE) inhibitors; similarly IL-1 inhibitors (Interleukin-1-converting enzyme inhibitors, IL-1RA etc.) may be effective for the same reason. Other combinations include Interleukin 11. Yet another combination includes key players of the autoimmune response which may act parallel to, dependent on, or in concert with, IL-12 function, especially IL-1β antagonists including IL-1β antibodies, soluble IL-1β receptors, and IL-1β binding proteins. It has been shown that IL-12 and IL-1β have overlapping but distinct functions and a combination of antagonists to both may be most effective. Yet another combination is non-depleting anti-CD4 inhibitors. Yet other combinations include antagonists of the co-stimulatory pathway CD80 (B7.1) or CD86 (B7.2) including antibodies, soluble receptors and antagonistic ligands.

The binding proteins provided herein may also be combined with agents, such as methotrexate, 6-MP, azathioprine sulphasalazine, mesalazine, olsalazine chloroquinine/hydroxychloroquine, pencillamine, aurothiomalate (intramuscular and oral), azathioprine, cochicine, corticosteroids (oral, inhaled and local injection), beta-2 adrenoreceptor agonists (salbutamol, terbutaline, salmeteral), xanthines (theophylline, aminophylline), cromoglycate, nedocromil, ketotifen, ipratropium and oxitropium, cyclosporin, FK506, rapamycin, mycophenolate mofetil, leflunomide, NSAIDs, for example, ibuprofen, corticosteroids such as prednisolone, phosphodiesterase inhibitors, adensosine agonists, antithrombotic agents, complement inhibitors, adrenergic agents, agents which interfere with signalling by proinflammatory cytokines, such as TNF-α or IL-1 (e.g., IRAK, NIK, IKK, p38 or MAP kinase inhibitors), IL-1β converting enzyme inhibitors, TNFα-converting enzyme (TACE) inhibitors, T-cell signalling inhibitors, such as kinase inhibitors, metalloproteinase inhibitors, sulfasalazine, azathioprine, 6-mercaptopurines, angiotensin converting enzyme inhibitors, soluble cytokine receptors and derivatives thereof (e.g., soluble p55 or p75 TNF receptors and the derivatives p75TNFRIgG (Enbrel™ and p55TNFRIgG (Lenercept)), sIL-1RI, sIL-1RII, and sIL-6R), antiinflammatory cytokines (e.g., IL-4, IL-10, IL-11, IL-13 and TGFβ), celecoxib, folic acid, hydroxychloroquine sulfate, rofecoxib, etanercept, infliximab, naproxen, valdecoxib, sulfasalazine, methylprednisolone, meloxicam, methylprednisolone acetate, gold sodium thiomalate, aspirin, triamcinolone acetonide, propoxyphene napsylate/apap, folate, nabumetone, diclofenac, piroxicam, etodolac, diclofenac sodium, oxaprozin, oxycodone hcl, hydrocodone bitartrate/apap, diclofenac sodium/misoprostol, fentanyl, anakinra, human recombinant, tramadol hcl, salsalate, sulindac, cyanocobalamin/fa/pyridoxine, acetaminophen, alendronate sodium, prednisolone, morphine sulfate, lidocaine hydrochloride, indomethacin, glucosamine sulf/chondroitin, amitriptyline hcl, sulfadiazine, oxycodone hcl/acetaminophen, olopatadine hcl, misoprostol, naproxen sodium, omeprazole, cyclophosphamide, rituximab, IL-1 TRAP, MRA, CTLA4-IG, IL-1β BP, anti-IL-18, Anti-IL15, BIRB-796, SC10-469, VX-702, AMG-548, VX-740, Roflumilast, IC-485, CDC-801, and Mesopram. Combinations include methotrexate or leflunomide and in moderate or severe rheumatoid arthritis cases, cyclosporine.

Nonlimiting additional agents, which can also be used in combination with a binding protein to treat rheumatoid arthritis include, but are not limited to, the following: non-steroidal anti-inflammatory drug(s) (NSAIDs); cytokine suppressive anti-inflammatory drug(s) (CSAIDs); CDP-571/BAY-10-3356 (humanized anti-TNFα antibody; Celltech/Bayer); cA2/infliximab (chimeric anti-TNFα antibody; Centocor); 75 kdTNFR-IgG/etanercept (75 kD TNF receptor-IgG fusion protein; Immunex; see e.g., (1994) Arthr. Rheum. 37: S295; (1996) J. Invest. Med. 44: 235A); 55 kdTNF-IgG (55 kD TNF receptor-IgG fusion protein; Hoffmann-LaRoche); IDEC-CE9.1/SB 210396 (non-depleting primatized anti-CD4 antibody; IDEC/SmithKline; see e.g., (1995) Arthr. Rheum. 38: S185); DAB 486-IL-2 and/or DAB 389-IL-2 (IL-2 fusion proteins; Seragen; see e.g., (1993) Arthrit. Rheum. 36: 1223); Anti-Tac (humanized anti-IL-2Rα; Protein Design Labs/Roche); IL-4 (anti-inflammatory cytokine; DNAX/Schering); IL-10 (SCH 52000; recombinant IL-10, anti-inflammatory cytokine; DNAX/Schering); IL-4; IL-10 and/or IL-4 agonists (e.g., agonist antibodies); IL-1RA (IL-1 receptor antagonist; Synergen/Amgen); anakinra (Kineret®/Amgen); TNF-bp/s-TNF (soluble TNF binding protein; see e.g., (1996) Arthr. Rheum. 39(9 (supplement)): S284; (1995) Amer. J. Physiol.-Heart and Circ. Physiol. 268: 37-42); R973401 (phosphodiesterase Type IV inhibitor; see e.g., (1996) Arthr. Rheum. 39(9 (supplement): S282); MK-966 (COX-2 Inhibitor; see e.g., (1996) Arthr. Rheum. 39(9 (supplement): S81); Iloprost (see e.g., (1996) Arthr. Rheum. 39(9 (supplement): S82); methotrexate; thalidomide (see e.g., (1996) Arthr. Rheum. 39(9 (supplement): S282) and thalidomide-related drugs (e.g., Celgen); leflunomide (anti-inflammatory and cytokine inhibitor; see e.g., (1996) Arthr. Rheum. 39(9 (supplement): S131; (1996) Inflamm. Res. 45: 103-107); tranexamic acid (inhibitor of plasminogen activation; see e.g., (1996) Arthr. Rheum. 39(9 (supplement): S284); T-614 (cytokine inhibitor; see e.g., (1996) Arthr. Rheum. 39(9 (supplement): S282); prostaglandin E1 (see e.g., (1996) Arthr. Rheum. 39(9 (supplement): S282); Tenidap (non-steroidal anti-inflammatory drug; see e.g., (1996) Arthr. Rheum. 39(9 (supplement): S280); Naproxen (non-steroidal anti-inflammatory drug; see e.g., (1996) Neuro. Report 7: 1209-1213); Meloxicam (non-steroidal anti-inflammatory drug); Ibuprofen (non-steroidal anti-inflammatory drug); Piroxicam (non-steroidal anti-inflammatory drug); Diclofenac (non-steroidal anti-inflammatory drug); Indomethacin (non-steroidal anti-inflammatory drug); Sulfasalazine (see e.g., (1996) Arthr. Rheum. 39(9 (supplement): S281); Azathioprine (see e.g., (1996) Arthr. Rheum. 39(9 (supplement): S281); ICE inhibitor (inhibitor of the enzyme interleukin-1β converting enzyme); zap-70 and/or lck inhibitor (inhibitor of the tyrosine kinase zap-70 or lck); VEGF inhibitor and/or VEGF-R inhibitor (inhibitors of vascular endothelial cell growth factor or vascular endothelial cell growth factor receptor; inhibitors of angiogenesis); corticosteroid anti-inflammatory drugs (e.g., SB203580); TNF-convertase inhibitors; anti-IL-12 antibodies; anti-IL-1β antibodies; interleukin-11 (see e.g., (1996) Arthr. Rheum. 39(9 (supplement): S296); interleukin-13 (see e.g., (1996) Arthr. Rheum. 39(9 (supplement): S308); interleukin-17 inhibitors (see e.g., (1996) Arthr. Rheum. 39(9 (supplement): S120); gold; penicillamine; chloroquine; chlorambucil; hydroxychloroquine; cyclosporine; cyclophosphamide; total lymphoid irradiation; anti-thymocyte globulin; anti-CD4 antibodies; CD5-toxins; orally-administered peptides and collagen; lobenzarit disodium; Cytokine Regulating Agents (CRAB) HP228 and HP466 (Houghten Pharmaceuticals, Inc.); ICAM-1 anti-sense phosphorothioate oligo-deoxynucleotides (ISIS 2302; Isis Pharmaceuticals, Inc.); soluble complement receptor 1 (TP10; T Cell Sciences, Inc.); prednisone; orgotein; glycosaminoglycan polysulphate; minocycline; anti-IL2R antibodies; marine and botanical lipids (fish and plant seed fatty acids; see e.g., DeLuca et al. (1995) Rheum. Dis. Clin. North Am. 21: 759-777); auranofin; phenylbutazone; meclofenamic acid; flufenamic acid; intravenous immune globulin; zileuton; azaribine; mycophenolic acid (RS-61443); tacrolimus (FK-506); sirolimus (rapamycin); amiprilose (therafectin); cladribine (2-chlorodeoxyadenosine); methotrexate; bcl-2 inhibitors (see Bruncko, M. et al. (2007) J. Med. Chem. 50(4): 641-662); and antivirals and immune-modulating agents.

In one embodiment, the binding protein or antigen-binding portion thereof, is administered in combination with one of the following agents for the treatment of rheumatoid arthritis: small molecule inhibitor of KDR, small molecule inhibitor of Tie-2; methotrexate; prednisone; celecoxib; folic acid; hydroxychloroquine sulfate; rofecoxib; etanercept; infliximab; leflunomide; naproxen; valdecoxib; sulfasalazine; methylprednisolone; ibuprofen; meloxicam; methylprednisolone acetate; gold sodium thiomalate; aspirin; azathioprine; triamcinolone acetonide; propoxyphene napsylate/apap; folate; nabumetone; diclofenac; piroxicam; etodolac; diclofenac sodium; oxaprozin; oxycodone hcl; hydrocodone bitartrate/apap; diclofenac sodium/misoprostol; fentanyl; anakinra, human recombinant; tramadol hcl; salsalate; sulindac; cyanocobalamin/fa/pyridoxine; acetaminophen; alendronate sodium; prednisolone; morphine sulfate; lidocaine hydrochloride; indomethacin; glucosamine sulfate/chondroitin; cyclosporine; amitriptyline hcl; sulfadiazine; oxycodone hcl/acetaminophen; olopatadine hcl; misoprostol; naproxen sodium; omeprazole; mycophenolate mofetil; cyclophosphamide; rituximab; IL-1 TRAP; MRA; CTLA4-IG; IL-1β BP; IL-12/23; anti-IL 18; anti-IL 15; BIRB-796; SC10-469; VX-702; AMG-548; VX-740; Roflumilast; IC-485; CDC-801; and mesopram.

Non-limiting examples of therapeutic agents for inflammatory bowel disease with which a binding protein provided herein can be combined include the following: budenoside; epidermal growth factor; corticosteroids; cyclosporin, sulfasalazine; aminosalicylates; 6-mercaptopurine; azathioprine; metronidazole; lipoxygenase inhibitors; mesalamine; olsalazine; balsalazide; antioxidants; thromboxane inhibitors; IL-1 receptor antagonists; anti-IL-1βmAbs; anti-IL-6 mAbs; growth factors; elastase inhibitors; pyridinyl-imidazole compounds; and antibodies to, or antagonists of, other human cytokines or growth factors, for example, TNF, LT, IL-1, IL-2, IL-6, IL-7, IL-8, IL-15, IL-16, IL-17, IL-18, EMAP-II, GM-CSF, FGF, and PDGF. Antibodies provided herein, or antigen binding portions thereof, can be combined with antibodies to cell surface molecules such as CD2, CD3, CD4, CD8, CD25, CD28, CD30, CD40, CD45, CD69, and CD90 and their ligands. The antibodies provided herein, or antigen binding portions thereof, may also be combined with agents, such as methotrexate, cyclosporin, FK506, rapamycin, mycophenolate mofetil, leflunomide, NSAIDs, such as ibuprofen, corticosteroids such as prednisolone, phosphodiesterase inhibitors, adenosine agonists, antithrombotic agents, complement inhibitors, adrenergic agents, agents which interfere with signalling by proinflammatory cytokines such as TNFα or IL-1 (e.g., IRAK, NIK, IKK, p38 or MAP kinase inhibitors), IL-1β converting enzyme inhibitors, TNFα converting enzyme inhibitors, T-cell signalling inhibitors such as kinase inhibitors, metalloproteinase inhibitors, sulfasalazine, azathioprine, 6-mercaptopurines, angiotensin converting enzyme inhibitors, soluble cytokine receptors and derivatives thereof (e.g., soluble p55 or p75 TNF receptors, sIL-1RI, sIL-1RII, and sIL-6R) and antiinflammatory cytokines (e.g., IL-4, IL-10, IL-11, IL-13 and TGFβ), and bcl-2 inhibitors.

Examples of therapeutic agents for Crohn's disease in which a binding protein can be combined include the following: TNF antagonists, for example, anti-TNF antibodies, ADALIMUMAB (PCT Publication No. WO 97/29131; HUMIRA), CA2 (REMICADE), CDP 571, TNFR-Ig constructs, (p75TNFRIgG (ENBREL) and p55TNFRIgG (LENERCEPT)) inhibitors and PDE4 inhibitors. Antibodies provided herein, or antigen binding portions thereof, can be combined with corticosteroids, for example, budenoside and dexamethasone. Binding proteins provided herein, or antigen binding portions thereof, may also be combined with agents such as sulfasalazine, 5-aminosalicylic acid and olsalazine, and agents which interfere with synthesis or action of proinflammatory cytokines such as IL-1, for example, IL-1β converting enzyme inhibitors and IL-1ra. Antibodies provided herein or antigen binding portion thereof may also be used with T cell signaling inhibitors, for example, tyrosine kinase inhibitors 6-mercaptopurines. Binding proteins provided herein, or antigen binding portions thereof, can be combined with IL-11. Binding proteins provided herein, or antigen binding portions thereof, can be combined with mesalamine, prednisone, azathioprine, mercaptopurine, infliximab, methylprednisolone sodium succinate, diphenoxylate/atrop sulfate, loperamide hydrochloride, methotrexate, omeprazole, folate, ciprofloxacin/dextrose-water, hydrocodone bitartrate/apap, tetracycline hydrochloride, fluocinonide, metronidazole, thimerosal/boric acid, cholestyramine/sucrose, ciprofloxacin hydrochloride, hyoscyamine sulfate, meperidine hydrochloride, midazolam hydrochloride, oxycodone hcl/acetaminophen, promethazine hydrochloride, sodium phosphate, sulfamethoxazole/trimethoprim, celecoxib, polycarbophil, propoxyphene napsylate, hydrocortisone, multivitamins, balsalazide disodium, codeine phosphate/apap, colesevelam hcl, cyanocobalamin, folic acid, levofloxacin, methylprednisolone, natalizumab and interferon-gamma Non-limiting examples of therapeutic agents for multiple sclerosis with which binding proteins provided herein can be combined include the following: corticosteroids; prednisolone; methylprednisolone; azathioprine; cyclophosphamide; cyclosporine; methotrexate; 4-aminopyridine; tizanidine; interferon-β1a (AVONEX; Biogen); interferon-β1b (BETASERON; Chiron/Berlex); interferon α-n3) (Interferon Sciences/Fujimoto), interferon-α (Alfa Wassermann/J&J), interferon β1A-1F (Serono/Inhale Therapeutics), Peginterferon α 2b (Enzon/Schering-Plough), Copolymer 1 (Cop-1; COPAXONE; Teva Pharmaceutical Industries, Inc.); hyperbaric oxygen; intravenous immunoglobulin; clabribine; antibodies to or antagonists of other human cytokines or growth factors and their receptors, for example, TNF, LT, IL-1, IL-2, IL-6, IL-7, IL-8, IL-23, IL-15, IL-16, IL-18, EMAP-II, GM-CSF, FGF, and PDGF. Binding proteins provided herein can be combined with antibodies to cell surface molecules such as CD2, CD3, CD4, CD8, CD19, CD20, CD25, CD28, CD30, CD40, CD45, CD69, CD80, CD86, CD90 or their ligands. Binding proteins provided herein, may also be combined with agents, such as methotrexate, cyclosporine, FK506, rapamycin, mycophenolate mofetil, leflunomide, NSAIDs, for example, ibuprofen, corticosteroids such as prednisolone, phosphodiesterase inhibitors, adenosone agonists, antithrombotic agents, complement inhibitors, adrenergic agents, agents which interfere with signalling by proinflammatory cytokines such as TNFα or IL-1 (e.g., IRAK, NIK, IKK, p38 or MAP kinase inhibitors), IL-1β converting enzyme inhibitors, TACE inhibitors, T-cell signaling inhibitors such as kinase inhibitors, metalloproteinase inhibitors, sulfasalazine, azathioprine, 6-mercaptopurines, angiotensin converting enzyme inhibitors, soluble cytokine receptors and derivatives thereof (e.g., soluble p55 or p75 TNF receptors, sIL-1RI, sIL-1RII, and sIL-6R), antiinflammatory cytokines (e.g., IL-4, IL-10, IL-13 and TGFβ) and bcl-2 inhibitors.

Examples of therapeutic agents for multiple sclerosis in which binding proteins provided herein can be combined include interferon-β, for example, IFNβ1a and IFNβ1b; copaxone, corticosteroids, caspase inhibitors, for example inhibitors of caspase-1, IL-1 inhibitors, TNF inhibitors, and antibodies to CD40 ligand and CD80.

The binding proteins provided herein, may also be combined with agents, such as alemtuzumab, dronabinol, Unimed, daclizumab, mitoxantrone, xaliproden hydrochloride, fampridine, glatiramer acetate, natalizumab, sinnabidol, a-immunokine NNSO3, ABR-215062, AnergiX.MS, chemokine receptor antagonists, BBR-2778, calagualine, CPI-1189, LEM (liposome encapsulated mitoxantrone), THC.CBD (cannabinoid agonist) MBP-8298, mesopram (PDE4 inhibitor), MNA-715, anti-IL-6 receptor antibody, neurovax, pirfenidone allotrap 1258 (RDP-1258), sTNF-R1, talampanel, teriflunomide, TGF-beta2, tiplimotide, VLA-4 antagonists (for example, TR-14035, VLA4 Ultrahaler, Antegran-ELAN/Biogen), interferon gamma antagonists, and IL-4 agonists.

Non-limiting examples of therapeutic agents for Angina with which binding proteins provided herein can be combined include the following: aspirin, nitroglycerin, isosorbide mononitrate, metoprolol succinate, atenolol, metoprolol tartrate, amlodipine besylate, diltiazem hydrochloride, isosorbide dinitrate, clopidogrel bisulfate, nifedipine, atorvastatin calcium, potassium chloride, furosemide, simvastatin, verapamil hcl, digoxin, propranolol hydrochloride, carvedilol, lisinopril, spironolactone, hydrochlorothiazide, enalapril maleate, nadolol, ramipril, enoxaparin sodium, heparin sodium, valsartan, sotalol hydrochloride, fenofibrate, ezetimibe, bumetanide, losartan potassium, lisinopril/hydrochlorothiazide, felodipine, captopril, and bisoprolol fumarate.

Non-limiting examples of therapeutic agents for Ankylosing Spondylitis with which binding proteins provided herein can be combined include the following: ibuprofen, diclofenac and misoprostol, naproxen, meloxicam, indomethacin, diclofenac, celecoxib, rofecoxib, Sulfasalazine, Methotrexate, azathioprine, minocyclin, prednisone, etanercept, and infliximab.

Non-limiting examples of therapeutic agents for Asthma with which binding proteins provided herein can be combined include the following: albuterol, salmeterol/fluticasone, montelukast sodium, fluticasone propionate, budesonide, prednisone, salmeterol xinafoate, levalbuterol hcl, albuterol sulfate/ipratropium, prednisolone sodium phosphate, triamcinolone acetonide, beclomethasone dipropionate, ipratropium bromide, azithromycin, pirbuterol acetate, prednisolone, theophylline anhydrous, methylprednisolone sodium succinate, clarithromycin, zafirlukast, formoterol fumarate, influenza virus vaccine, methylprednisolone, amoxicillin trihydrate, flunisolide, allergy injection, cromolyn sodium, fexofenadine hydrochloride, flunisolide/menthol, amoxicillin/clavulanate, levofloxacin, inhaler assist device, guaifenesin, dexamethasone sodium phosphate, moxifloxacin hcl, doxycycline hyclate, guaifenesin/d-methorphan, p-ephedrine/cod/chlorphenir, gatifloxacin, cetirizine hydrochloride, mometasone furoate, salmeterol xinafoate, benzonatate, cephalexin, pe/hydrocodone/chlorphenir, cetirizine hcl/pseudoephed, phenylephrine/cod/promethazine, codeine/promethazine, cefprozil, dexamethasone, guaifenesin/pseudoephedrine, chlorpheniramine/hydrocodone, nedocromil sodium, terbutaline sulfate, epinephrine, methylprednisolone, and metaproterenol sulfate.

Non-limiting examples of therapeutic agents for COPD with which binding proteins provided herein can be combined include the following: albuterol sulfate/ipratropium, ipratropium bromide, salmeterol/fluticasone, albuterol, salmeterol xinafoate, fluticasone propionate, prednisone, theophylline anhydrous, methylprednisolone sodium succinate, montelukast sodium, budesonide, formoterol fumarate, triamcinolone acetonide, levofloxacin, guaifenesin, azithromycin, beclomethasone dipropionate, levalbuterol hcl, flunisolide, ceftriaxone sodium, amoxicillin trihydrate, gatifloxacin, zafirlukast, amoxicillin/clavulanate, flunisolide/menthol, chlorpheniramine/hydrocodone, metaproterenol sulfate, methylprednisolone, mometasone furoate, p-ephedrine/cod/chlorphenir, pirbuterol acetate, p-ephedrine/loratadine, terbutaline sulfate, tiotropium bromide, (R,R)-formoterol, TgAAT, Cilomilast, and Roflumilast.

Non-limiting examples of therapeutic agents for HCV with which binding proteins provided herein can be combined include the following: Interferon-alpha-2a, Interferon-alpha-2b, Interferon-alpha con1, Interferon-alpha-n1, Pegylated interferon-alpha-2a, Pegylated interferon-alpha-2b, ribavirin, Peginterferon alfa-2b+ribavirin, Ursodeoxycholic Acid, Glycyrrhizic Acid, Thymalfasin, Maxamine, VX-497 and any compounds that are used to treat HCV through intervention with the following targets: HCV polymerase, HCV protease, HCV helicase, and HCV IRES (internal ribosome entry site).

Non-limiting examples of therapeutic agents for Idiopathic Pulmonary Fibrosis with which binding proteins provided herein can be combined include the following: prednisone, azathioprine, albuterol, colchicine, albuterol sulfate, digoxin, gamma interferon, methylprednisolone sod succ, lorazepam, furosemide, lisinopril, nitroglycerin, spironolactone, cyclophosphamide, ipratropium bromide, actinomycin d, alteplase, fluticasone propionate, levofloxacin, metaproterenol sulfate, morphine sulfate, oxycodone hcl, potassium chloride, triamcinolone acetonide, tacrolimus anhydrous, calcium, interferon-alpha, methotrexate, mycophenolate mofetil, and Interferon-gamma-1β.

Non-limiting examples of therapeutic agents for Myocardial Infarction with which binding proteins provided herein can be combined include the following: aspirin, nitroglycerin, metoprolol tartrate, enoxaparin sodium, heparin sodium, clopidogrel bisulfate, carvedilol, atenolol, morphine sulfate, metoprolol succinate, warfarin sodium, lisinopril, isosorbide mononitrate, digoxin, furosemide, simvastatin, ramipril, tenecteplase, enalapril maleate, torsemide, retavase, losartan potassium, quinapril hcl/mag carb, bumetanide, alteplase, enalaprilat, amiodarone hydrochloride, tirofiban hcl m-hydrate, diltiazem hydrochloride, captopril, irbesartan, valsartan, propranolol hydrochloride, fosinopril sodium, lidocaine hydrochloride, eptifibatide, cefazolin sodium, atropine sulfate, aminocaproic acid, spironolactone, interferon, sotalol hydrochloride, potassium chloride, docusate sodium, dobutamine hcl, alprazolam, pravastatin sodium, atorvastatin calcium, midazolam hydrochloride, meperidine hydrochloride, isosorbide dinitrate, epinephrine, dopamine hydrochloride, bivalirudin, rosuvastatin, ezetimibe/simvastatin, avasimibe, and cariporide.

Non-limiting examples of therapeutic agents for Psoriasis with which binding proteins provided herein can be combined include the following: small molecule inhibitor of KDR, small molecule inhibitor of Tie-2, calcipotriene, clobetasol propionate, triamcinolone acetonide, halobetasol propionate, tazarotene, methotrexate, fluocinonide, betamethasone diprop augmented, fluocinolone acetonide, acitretin, tar shampoo, betamethasone valerate, mometasone furoate, ketoconazole, pramoxine/fluocinolone, hydrocortisone valerate, flurandrenolide, urea, betamethasone, clobetasol propionate/emoll, fluticasone propionate, azithromycin, hydrocortisone, moisturizing formula, folic acid, desonide, pimecrolimus, coal tar, diflorasone diacetate, etanercept folate, lactic acid, methoxsalen, hc/bismuth subgal/znox/resor, methylprednisolone acetate, prednisone, sunscreen, halcinonide, salicylic acid, anthralin, clocortolone pivalate, coal extract, coal tar/salicylic acid, coal tar/salicylic acid/sulfur, desoximetasone, diazepam, emollient, fluocinonide/emollient, mineral oil/castor oil/na lact, mineral oil/peanut oil, petroleum/isopropyl myristate, psoralen, salicylic acid, soap/tribromsalan, thimerosal/boric acid, celecoxib, infliximab, cyclosporine, alefacept, efalizumab, tacrolimus, pimecrolimus, PUVA, UVB, and sulfasalazine.

Non-limiting examples of therapeutic agents for Psoriatic Arthritis with which binding proteins provided herein can be combined include the following: methotrexate, etanercept, rofecoxib, celecoxib, folic acid, sulfasalazine, naproxen, leflunomide, methylprednisolone acetate, indomethacin, hydroxychloroquine sulfate, prednisone, sulindac, betamethasone diprop augmented, infliximab, methotrexate, folate, triamcinolone acetonide, diclofenac, dimethylsulfoxide, piroxicam, diclofenac sodium, ketoprofen, meloxicam, methylprednisolone, nabumetone, tolmetin sodium, calcipotriene, cyclosporine, diclofenac sodium/misoprostol, fluocinonide, glucosamine sulfate, gold sodium thiomalate, hydrocodone bitartrate/apap, ibuprofen, risedronate sodium, sulfadiazine, thioguanine, valdecoxib, alefacept, efalizumab and bcl-2 inhibitors.

Non-limiting examples of therapeutic agents for Restenosis with which binding proteins provided herein can be combined include the following: sirolimus, paclitaxel, everolimus, tacrolimus, Zotarolimus, and acetaminophen.

Non-limiting examples of therapeutic agents for Sciatica with which binding proteins provided herein can be combined include the following: hydrocodone bitartrate/apap, rofecoxib, cyclobenzaprine hcl, methylprednisolone, naproxen, ibuprofen, oxycodone hcl/acetaminophen, celecoxib, valdecoxib, methylprednisolone acetate, prednisone, codeine phosphate/apap, tramadol hcl/acetaminophen, metaxalone, meloxicam, methocarbamol, lidocaine hydrochloride, diclofenac sodium, gabapentin, dexamethasone, carisoprodol, ketorolac tromethamine, indomethacin, acetaminophen, diazepam, nabumetone, oxycodone hcl, tizanidine hcl, diclofenac sodium/misoprostol, propoxyphene napsylate/apap, asa/oxycod/oxycodone ter, ibuprofen/hydrocodone bit, tramadol hcl, etodolac, propoxyphene hcl, amitriptyline hcl, carisoprodol/codeine phos/asa, morphine sulfate, multivitamins, naproxen sodium, orphenadrine citrate, and temazepam.

Examples of therapeutic agents for SLE (Lupus) in which binding proteins provided herein can be combined include the following: NSAIDS, for example, diclofenac, naproxen, ibuprofen, piroxicam, indomethacin; COX2 inhibitors, for example, Celecoxib, rofecoxib, valdecoxib; anti-malarials, for example, hydroxychloroquine; Steroids, for example, prednisone, prednisolone, budenoside, dexamethasone; Cytotoxics, for example, azathioprine, cyclophosphamide, mycophenolate mofetil, methotrexate; and inhibitors of PDE4 or a purine synthesis inhibitor, for example Cellcept. Binding proteins provided herein may also be combined with agents such as sulfasalazine, 5-aminosalicylic acid, olsalazine, Imuran and agents which interfere with synthesis, production or action of proinflammatory cytokines such as IL-1, for example, caspase inhibitors like IL-1β converting enzyme inhibitors and IL-1ra. Binding proteins provided herein may also be used with T cell signaling inhibitors, for example, tyrosine kinase inhibitors; or molecules that target T cell activation molecules, for example, CTLA-4-IgG or anti-B7 family antibodies, and anti-PD-1 family antibodies. Binding proteins provided herein can be combined with IL-11 or anti-cytokine antibodies, for example, fonotolizumab (anti-IFNg antibody), or anti-receptor receptor antibodies, for example, anti-IL-6 receptor antibody and antibodies to B-cell surface molecules. Antibodies provided herein or antigen binding portion thereof may also be used with LJP 394 (abetimus), agents that deplete or inactivate B-cells, for example, Rituximab (anti-CD20 antibody), lymphostat-B (anti-BlyS antibody), TNF antagonists, for example, anti-TNF antibodies, Adalimumab (PCT Publication No. WO 97/29131; HUMIRA), CA2 (REMICADE), CDP 571, TNFR-Ig constructs, (p75TNFRIgG (ENBREL) and p55TNFRIgG (LENERCEPT)) and bcl-2 inhibitors, because bcl-2 overexpression in transgenic mice has been demonstrated to cause a lupus like phenotype (see Marquina, R. et al. (2004) J. Immunol. 172(11): 7177-7185), therefore inhibition is expected to have therapeutic effects.

The pharmaceutical compositions provided herein may include a "therapeutically effective amount" or a "prophylactically effective amount" of a binding protein provided herein. A "therapeutically effective amount" refers to an amount effective, at dosages and for periods of time necessary, to achieve the desired therapeutic result. A therapeutically effective amount of the binding protein may be determined by a person skilled in the art and may vary according to factors such as the disease state, age, sex, and weight of the individual, and the ability of the binding protein to elicit a desired response in the individual. A therapeutically effective amount is also one in which any toxic or detrimental effects of the antibody, or antibody portion, are outweighed by the therapeutically beneficial effects. A "prophylactically effective amount" refers to an amount effective, at dosages and for periods of time necessary, to achieve the desired prophylactic result. Typically, since a prophylactic dose is used in subjects prior to or at an earlier stage of disease, the prophylactically effective amount will be less than the therapeutically effective amount.

Dosage regimens may be adjusted to provide the optimum desired response (e.g., a therapeutic or prophylactic response). For example, a single bolus may be administered, several divided doses may be administered over time or the dose may be proportionally reduced or increased as indicated by the exigencies of the therapeutic situation. It is especially advantageous to formulate parenteral compositions in dosage unit form for ease of administration and uniformity of dosage. Dosage unit form as used herein refers to physically discrete units suited as unitary dosages for the mammalian subjects to be treated; each unit containing a predetermined quantity of active compound calculated to produce the desired therapeutic effect in association with the required pharmaceutical carrier. The specification for the dosage unit forms are dictated by and directly dependent on (a) the unique characteristics of the active compound and the particular therapeutic or prophylactic effect to be achieved, and (b) the limitations inherent in the art of compounding such an active compound for the treatment of sensitivity in individuals.

An exemplary, non-limiting range for a therapeutically or prophylactically effective amount of a binding protein provided herein is 0.1-20 mg/kg, for example, 1-10 mg/kg. It is to be noted that dosage values may vary with the type and severity of the condition to be alleviated. It is to be further understood that for any particular subject, specific dosage regimens should be adjusted over time according to the individual need and the professional judgment of the person administering or supervising the administration of the compositions, and that dosage ranges set forth herein are exemplary only and are not intended to limit the scope or practice of the claimed composition.

V. Diagnostics

The disclosure herein also provides diagnostic applications. This is further elucidated below.

A. Method of Assay

The present disclosure also provides a method for determining the presence, amount or concentration of an analyte (or a fragment thereof) in a test sample using at least one DVD-Ig as described herein. Any suitable assay as is known in the art can be used in the method. Examples include, but are not limited to, immunoassay, such as sandwich immunoassay (e.g., monoclonal, polyclonal and/or DVD-Ig sandwich immunoassays or any variation thereof (e.g., monoclonal/DVD-Ig, DVD-Ig/polyclonal, etc.), including radioisotope detection (radioimmunoassay (RIA)) and enzyme detection (enzyme immunoassay (EIA) or enzyme-linked immunosorbent assay (ELISA) (e.g., Quantikine ELISA assays, R&D Systems, Minneapolis, Minn.))), competitive inhibition immunoassay (e.g., forward and reverse), fluorescence polarization immunoassay (FPIA), enzyme multiplied immunoassay technique (EMIT), bioluminescence resonance energy transfer (BRET), and homogeneous chemiluminescent assay, etc. In a SELDI-based immunoassay, a capture reagent that specifically binds an analyte (or a fragment thereof) of interest is attached to the surface of a mass spectrometry probe, such as a pre-activated protein chip array. The analyte (or a fragment thereof) is then specifically captured on the biochip, and the captured analyte (or a fragment thereof) is detected by mass spectrometry. Alternatively, the analyte (or a fragment thereof) can be eluted from the capture reagent and detected by traditional MALDI (matrix-assisted laser desorption/ionization) or by SELDI. A chemiluminescent microparticle immunoassay, in particular one employing the ARCHITECT® automated analyzer (Abbott Laboratories, Abbott Park, Ill.), is an example of a preferred immunoassay.

Methods well-known in the art for collecting, handling and processing urine, blood, serum and plasma, and other body fluids, are used in the practice of the present disclosure, for instance, when a DVD-Ig as described herein is employed as an immunodiagnostic reagent and/or in an analyte immunoassay kit. The test sample can comprise further moieties in addition to the analyte of interest, such as antibodies, antigens, haptens, hormones, drugs, enzymes, receptors, proteins, peptides, polypeptides, oligonucleotides and/or polynucleotides. For example, the sample can be a whole blood sample obtained from a subject. It can be necessary or desired that a test sample, particularly whole blood, be treated prior to immunoassay as described herein, e.g., with a pretreatment reagent. Even in cases where pretreatment is not necessary (e.g., most urine samples), pretreatment optionally can be done (e.g., as part of a regimen on a commercial platform).

The pretreatment reagent can be any reagent appropriate for use with the immunoassay and kits provided herein. The pretreatment optionally comprises: (a) one or more solvents (e.g., methanol and ethylene glycol) and optionally, salt, (b) one or more solvents and salt, and optionally, detergent, (c) detergent, or (d) detergent and salt. Pretreatment reagents are known in the art, and such pretreatment can be employed, e.g., as used for assays on Abbott TDx, AxSYM®, and ARCHITECT® analyzers (Abbott Laboratories, Abbott Park, Ill.), as described in the literature (see, e.g., Yatscoff et al., (1990) Clin. Chem. 36: 1969-1973 and Wallemacq et al. (1999) Clin. Chem. 45: 432-435), and/or as commercially available. Additionally, pretreatment can be done as described in U.S. Pat. No. 5,135,875, EU Patent Publication No. EU0471293, U.S. Pat. No. 6,660,843, and U.S. Patent Application No. 20080020401. The pretreatment reagent can be a heterogeneous agent or a homogeneous agent.

With use of a heterogeneous pretreatment reagent, the pretreatment reagent precipitates analyte binding protein (e.g., protein that can bind to an analyte or a fragment thereof) present in the sample. Such a pretreatment step comprises removing any analyte binding protein by separating from the precipitated analyte binding protein the supernatant of the mixture formed by addition of the pretreatment agent to sample. In such an assay, the supernatant of the mixture absent any binding protein is used in the assay, proceeding directly to the antibody capture step.

With use of a homogeneous pretreatment reagent there is no such separation step. The entire mixture of test sample and pretreatment reagent are contacted with a labeled specific binding partner for analyte (or a fragment thereof), such as a labeled anti-analyte antibody (or an antigenically reactive fragment thereof). The pretreatment reagent employed for such an assay typically is diluted in the pretreated test sample mixture, either before or during capture by the first specific binding partner. Despite such dilution, a certain amount of the pretreatment reagent is still present (or remains) in the test sample mixture during capture. In one embodiment, the labeled specific binding partner can be a DVD-Ig (or a fragment, a variant, or a fragment of a variant thereof).

In a heterogeneous format, after the test sample is obtained from a subject, a first mixture is prepared. The mixture contains the test sample being assessed for an analyte (or a fragment thereof) and a first specific binding partner, wherein the first specific binding partner and any analyte contained in the test sample form a first specific binding partner-analyte complex. Preferably, the first specific binding partner is an anti-analyte antibody or a fragment thereof. The first specific binding partner can be a DVD-Ig (or a fragment, a variant, or a fragment of a variant thereof) as described herein. The order in which the test sample and the first specific binding partner are added to form the mixture is not critical. Preferably, the first specific binding partner is immobilized on a solid phase. The solid phase used in the immunoassay (for the first specific binding partner and, optionally, the second specific binding partner) can be any solid phase known in the art, such as, but not limited to, a magnetic particle, a bead, a test tube, a microtiter plate, a cuvette, a membrane, a scaffolding molecule, a film, a filter paper, a disc and a chip.

After the mixture containing the first specific binding partner-analyte complex is formed, any unbound analyte is removed from the complex using any technique known in the art. For example, the unbound analyte can be removed by washing. Desirably, however, the first specific binding partner is present in excess of any analyte present in the test sample, such that all analyte that is present in the test sample is bound by the first specific binding partner.

After any unbound analyte is removed, a second specific binding partner is added to the mixture to form a first specific binding partner-analyte-second specific binding partner complex. The second specific binding partner is preferably an anti-analyte antibody that binds to an epitope on analyte that differs from the epitope on analyte bound by the first specific binding partner. Moreover, also preferably, the second specific binding partner is labeled with or contains a detectable label as described above. The second specific binding partner can be a DVD-Ig (or a fragment, a variant, or a fragment of a variant thereof) as described herein.

Any suitable detectable label as is known in the art can be used. For example, the detectable label can be a radioactive label (such as $^3$H, $^{125}$I, $^{35}$S, $^{14}$C, $^{32}$P, and $^{33}$P), an enzymatic label (such as horseradish peroxidase, alkaline peroxidase, glucose 6-phosphate dehydrogenase, and the like), a chemiluminescent label (such as acridinium esters, thioesters, or sulfonamides; luminol, isoluminol, phenanthridinium esters, and the like), a fluorescent label (such as fluorescein (e.g., 5-fluorescein, 6-carboxyfluorescein, 3'6-carboxyfluorescein, 5(6)-carboxyfluorescein, 6-hexachloro-fluorescein, 6-tetrachlorofluorescein, fluorescein isothiocyanate, and the like)), rhodamine, phycobiliproteins, R-phycoerythrin, quantum dots (e.g., zinc sulfide-capped cadmium selenide), a thermometric label, or an immuno-polymerase chain reaction label. An introduction to labels, labeling procedures and detection of labels is found in Polak and Van Noorden, *Introduction to Immunocytochemistry*, $2^{nd}$ ed., Springer Verlag, N.Y. (1997), and in Haugland, *Handbook of Fluorescent Probes and Research Chemicals* (1996), which is a combined handbook and catalogue published by Molecular Probes, Inc., Eugene, Oreg. A fluorescent label can be used in FPIA (see, e.g., U.S. Pat. Nos. 5,593,896; 5,573,904; 5,496,925; 5,359,093; and 5,352,803. An acridinium compound can be used as a detectable label in a homogeneous or heterogeneous chemiluminescent assay (see, e.g., Adamczyk et al. (2006) Bioorg. Med. Chem. Lett. 16: 1324-1328; Adamczyk et al. (2004) Bioorg. Med. Chem. Lett. 4: 2313-2317; Adamczyk et al. (2004) Biorg. Med. Chem. Lett. 14: 3917-3921; and Adamczyk et al. (2003) Org. Lett. 5: 3779-3782).

A preferred acridinium compound is an acridinium-9-carboxamide. Methods for preparing acridinium 9-carboxamides are described in Mattingly (1991) J. Biolumin. Chemilumin. 6: 107-114; Adamczyk et al. (1998) J. Org. Chem. 63: 5636-5639; Adamczyk et al. (1999) Tetrahedron 55: 10899-10914; Adamczyk et al. (1999) Org. Lett. 1: 779-781; Adamczyk et al. (2000) Biocon. Chem. 11: 714-724; Mattingly et al., In Luminescence Biotechnology Instruments and Applications; Dyke, K. V. Ed.; CRC Press: Boca Raton, pp. 77-105 (2002); Adamczyk et al. (2003) Org. Lett. 5: 3779-3782; and U.S. Pat. Nos. 5,468,646; 5,543, 524; and 5,783,699. Another preferred acridinium compound is an acridinium-9-carboxylate aryl ester. An example of an acridinium-9-carboxylate aryl ester is 10-methyl-9-(phenoxycarbonyl)acridinium fluorosulfonate (available from Cayman Chemical, Ann Arbor, Mich.). Methods for preparing acridinium 9-carboxylate aryl esters are described in McCapra et al. (1965) Photochem. Photobiol. 4: 1111-21; Razavi et al. (2000) Luminescence 15: 245-249; Razavi et al. (2000) Luminescence 15: 239-244; and U.S. Pat. No. 5,241,070. Further details regarding acridinium-9-carboxylate aryl ester and its use are set forth in US Patent Publication No. 20080248493.

Chemiluminescent assays (e.g., using acridinium as described above or other chemiluminescent agents) can be performed in accordance with the methods described in Adamczyk et al. (2006) Anal. Chim. Acta 579(1): 61-67. While any suitable assay format can be used, a microplate chemiluminometer (Mithras LB-940, Berthold Technologies U.S.A., LLC, Oak Ridge, Tenn.) enables the assay of multiple samples of small volumes rapidly.

The order in which the test sample and the specific binding partner(s) are added to form the mixture for chemiluminescent assay is not critical. If the first specific binding partner is detectably labeled with a chemiluminescent agent such as an acridinium compound, detectably labeled first specific binding partner-analyte complexes form. Alternatively, if a second specific binding partner is used and the second specific binding partner is detectably labeled with a chemiluminescent agent such as an acridinium compound, detectably labeled first specific binding partner-analyte-second specific binding partner complexes form. Any unbound specific binding partner, whether labeled or unlabeled, can be removed from the mixture using any technique known in the art, such as washing.

Hydrogen peroxide can be generated in situ in the mixture or provided or supplied to the mixture (e.g., the source of the hydrogen peroxide being one or more buffers or other solutions that are known to contain hydrogen peroxide) before, simultaneously with, or after the addition of an above-described acridinium compound. Hydrogen peroxide can be generated in situ in a number of ways such as would be apparent to one skilled in the art.

Upon the simultaneous or subsequent addition of at least one basic solution to the sample, a detectable signal, namely, a chemiluminescent signal, indicative of the presence of analyte is generated. The basic solution contains at least one base and has a pH greater than or equal to 10, preferably, greater than or equal to 12. Examples of basic solutions include, but are not limited to, sodium hydroxide, potassium hydroxide, calcium hydroxide, ammonium hydroxide, magnesium hydroxide, sodium carbonate, sodium bicarbonate, calcium hydroxide, calcium carbonate, and calcium bicarbonate. The amount of basic solution added to the sample depends on the concentration of the basic solution. Based on the concentration of the basic solution used, one skilled in the art can easily determine the amount of basic solution to add to the sample.

The chemiluminescent signal that is generated can be detected using routine techniques known to those skilled in the art. Based on the intensity of the signal generated, the amount of analyte in the sample can be quantified. Specifically, the amount of analyte in the sample is proportional to the intensity of the signal generated. The amount of analyte present can be quantified by comparing the amount of light generated to a standard curve for analyte or by comparison to a reference standard. The standard curve can be generated using serial dilutions or solutions of known concentrations of analyte by mass spectroscopy, gravimetric methods, and other techniques known in the art. While the above is described with emphasis on use of an acridinium compound as the chemiluminescent agent, one of ordinary skill in the art can readily adapt this description for use of other chemiluminescent agents.

Analyte immunoassays generally can be conducted using any format known in the art, such as, but not limited to, a sandwich format. Specifically, in one immunoassay format, at least two antibodies are employed to separate and quantify analyte, such as human analyte, or a fragment thereof in a sample. More specifically, the at least two antibodies bind to different epitopes on an analyte (or a fragment thereof) forming an immune complex, which is referred to as a "sandwich." Generally, in the immunoassays one or more antibodies can be used to capture the analyte (or a fragment thereof) in the test sample (these antibodies are frequently referred to as a "capture" antibody or "capture" antibodies) and one or more antibodies can be used to bind a detectable (namely, quantifiable) label to the sandwich (these antibodies are frequently referred to as the "detection antibody," the "detection antibodies," the "conjugate," or the "conjugates"). Thus, in the context of a sandwich immunoassay format, a binding protein or a DVD-Ig (or a fragment, a variant, or a fragment of a variant thereof) as described herein can be used as a capture antibody, a detection antibody, or both. For example, one binding protein or DVD-Ig having a domain that can bind a first epitope on an analyte (or a fragment thereof) can be used as a capture agent and/or another binding protein or DVD-Ig having a domain that can bind a second epitope on an analyte (or a fragment thereof) can be used as a detection agent. In this regard, a binding protein or a DVD-Ig having a first domain that can bind a first epitope on an analyte (or a fragment thereof) and a second domain that can bind a second epitope on an analyte (or a fragment thereof) can be used as a capture agent and/or a detection agent. Alternatively, one binding protein or DVD-Ig having a first domain that can bind an epitope on a first analyte (or a fragment thereof) and a second domain that can bind an epitope on a second analyte (or a fragment thereof) can be used as a capture agent and/or a detection agent to detect, and optionally quantify, two or more analytes. In the event that an analyte can be present in a sample in more than one form, such as a monomeric form and a dimeric/multimeric form, which can be homomeric or heteromeric, one binding protein or DVD-Ig having a domain that can bind an epitope that is only exposed on the monomeric form and another binding protein or DVD-Ig having a domain that can bind an epitope on a different part of a dimeric/multimeric form can be used as capture agents and/or detection agents, thereby enabling the detection, and optional quantification, of different forms of a given analyte. Furthermore, employing binding proteins or DVD-Igs with differential affinities within a single binding protein or DVD-Ig and/or between binding proteins or DVD-Igs can provide an avidity advantage. In the context of immunoassays as described herein, it generally may be helpful or desired to incorporate one or more linkers within the structure of a binding protein or a DVD-Ig. When present, optimally the linker should be of sufficient length and structural flexibility to enable binding of an epitope by the inner domains as well as binding of another epitope by the outer domains. In this regard, when a binding protein or a DVD-Ig can bind two different analytes and one analyte is larger than the other, desirably the larger analyte is bound by the outer domains.

Generally speaking, a sample being tested for (for example, suspected of containing) analyte (or a fragment thereof) can be contacted with at least one capture agent (or agents) and at least one detection agent (which can be a second detection agent or a third detection agent or even a successively numbered agent, e.g., as where the capture and/or detection agent comprises multiple agents) either simultaneously or sequentially and in any order. For example, the test sample can be first contacted with at least one capture agent and then (sequentially) with at least one detection agent. Alternatively, the test sample can be first contacted with at least one detection agent and then (sequentially) with at least one capture agent. In yet another alternative, the test sample can be contacted simultaneously with a capture agent and a detection agent.

In the sandwich assay format, a sample suspected of containing analyte (or a fragment thereof) is first brought into contact with at least one first capture agent under conditions that allow the formation of a first agent/analyte complex. If more than one capture agent is used, a first capture agent/analyte complex comprising two or more capture agents is formed. In a sandwich assay, the agents, i.e., preferably, the at least one capture agent, are used in molar excess amounts of the maximum amount of analyte (or a fragment thereof) expected in the test sample. For example, from about 5 µg to about 1 mg of agent per mL of buffer (e.g., microparticle coating buffer) can be used.

Competitive inhibition immunoassays, which are often used to measure small analytes because binding by only one antibody (i.e., a binding protein and/or a DVD-Ig in the context of the present disclosure) is required, comprise sequential and classic formats. In a sequential competitive inhibition immunoassay a capture agent to an analyte of interest is coated onto a well of a microtiter plate or other solid support. When the sample containing the analyte of interest is added to the well, the analyte of interest binds to the capture agent. After washing, a known amount of labeled (e.g., biotin or horseradish peroxidase (HRP)) analyte capable of binding the capture antibody is added to the well. A substrate for an enzymatic label is necessary to generate a signal. An example of a suitable substrate for HRP is 3,3',5,5'-tetramethylbenzidine (TMB). After washing, the signal generated by the labeled analyte is measured and is inversely proportional to the amount of analyte in the sample. In a classic competitive inhibition immunoassay typically an antibody (i.e., a binding protein and/or a DVD-Ig in the context of the present disclosure) to an analyte of interest is coated onto a solid support (e.g., a well of a microtiter plate). However, unlike the sequential competitive inhibition immunoassay, the sample and the labeled analyte are added to the well at the same time. Any analyte in the sample competes with labeled analyte for binding to the capture agent. After washing, the signal generated by the labeled analyte is measured and is inversely proportional to the amount of analyte in the sample. Of course, there are many variations of these formats—e.g., such as when binding to the solid substrate takes place, whether the format is one-step, two-step, delayed two-step, and the like—and these would be recognized by one of ordinary skill in the art.

Optionally, prior to contacting the test sample with the at least one capture agent (for example, the first capture agent), the at least one capture agent can be bound to a solid support, which facilitates the separation of the first agent/analyte (or a fragment thereof) complex from the test sample. The substrate to which the capture agent is bound can be any suitable solid support or solid phase that facilitates separation of the capture agent-analyte complex from the sample.

Examples include a well of a plate, such as a microtiter plate, a test tube, a porous gel (e.g., silica gel, agarose, dextran, or gelatin), a polymeric film (e.g., polyacrylamide), beads (e.g., polystyrene beads or magnetic beads), a strip of a filter/membrane (e.g., nitrocellulose or nylon), microparticles (e.g., latex particles, magnetizable microparticles (e.g., microparticles having ferric oxide or chromium oxide cores and homo- or hetero-polymeric coats and radii of about 1-10 microns). The substrate can comprise a suitable porous material with a suitable surface affinity to bind antigens and sufficient porosity to allow access by detection antibodies. A microporous material is generally preferred, although a gelatinous material in a hydrated state can be used. Such porous substrates are preferably in the form of sheets having a thickness of about 0.01 to about 0.5 mm, preferably about 0.1 mm. While the pore size may vary quite a bit, preferably the pore size is from about 0.025 to about 15 microns, more preferably from about 0.15 to about 15 microns. The surface of such substrates can be passively coated or activated by chemical processes that cause covalent linkage of an antibody to the substrate. Irreversible binding, generally by adsorption through hydrophobic forces, of the antigen or the antibody to the substrate results; alternatively, a chemical coupling agent or other means can be used to bind covalently the antibody to the substrate, provided that such binding does not interfere with the ability of the antibody to bind to analyte. Alternatively, the antibody (i.e., binding protein and/or DVD-Ig in the context of the present disclosure) can be bound with microparticles, which have been previously coated with streptavidin (e.g., DYNAL® Magnetic Beads, Invitrogen, Carlsbad, Calif.) or biotin (e.g., using PowerBind™-SA-MP streptavidin-coated microparticles (Seradyn, Indianapolis, Ind.)) or anti-species-specific monoclonal antibodies (i.e., binding proteins and/or DVD-Igs in the context of the present disclosure). If necessary or desired, the substrate (e.g., for the label) can be derivatized to allow reactivity with various functional groups on the antibody (i.e., binding protein or DVD-Ig in the context of the present disclosure). Such derivatization requires the use of certain coupling agents, examples of which include, but are not limited to, maleic anhydride, N-hydroxysuccinimide, and 1-ethyl-3-(3-dimethylaminopropyl) carbodiimide. If desired, one or more capture agents, such as antibodies (or fragments thereof) (i.e., binding proteins and/or DVD-Igs in the context of the present disclosure), each of which is specific for analyte(s) can be attached to solid phases in different physical or addressable locations (e.g., such as in a biochip configuration (see, e.g., U.S. Pat. No. 6,225,047; PCT Publication No. WO 99/51773; U.S. Pat. No. 6,329,209; PCT Publication No. WO 00/56934, and U.S. Pat. No. 5,242,828). If the capture agent is attached to a mass spectrometry probe as the solid support, the amount of analyte bound to the probe can be detected by laser desorption ionization mass spectrometry. Alternatively, a single column can be packed with different beads, which are derivatized with the one or more capture agents, thereby capturing the analyte in a single place (see, antibody-derivatized, bead-based technologies, e.g., the xMAP technology of Luminex (Austin, Tex.)).

After the test sample being assayed for analyte (or a fragment thereof) is brought into contact with the at least one capture agent (for example, the first capture agent), the mixture is incubated in order to allow for the formation of a first capture agent (or multiple capture agent)-analyte (or a fragment thereof) complex. The incubation can be carried out at a pH of from about 4.5 to about 10.0, at a temperature of from about 2° C. to about 45° C., and for a period from at least about one (1) minute to about eighteen (18) hours, preferably from about 1 to about 24 minutes, most preferably for about 4 to about 18 minutes. The immunoassay described herein can be conducted in one step (meaning the test sample, at least one capture agent and at least one detection agent are all added sequentially or simultaneously to a reaction vessel) or in more than one step, such as two steps, three steps, etc.

After formation of the (first or multiple) capture agent/analyte (or a fragment thereof) complex, the complex is then contacted with at least one detection agent under conditions which allow for the formation of a (first or multiple) capture agent/analyte (or a fragment thereof)/second detection agent complex). While captioned for clarity as the "second" agent (e.g., second detection agent), in fact, where multiple agents are used for capture and/or detection, the at least one detection agent can be the second, third, fourth, etc., agents used in the immunoassay. If the capture agent/analyte (or a fragment thereof) complex is contacted with more than one detection agent, then a (first or multiple) capture agent/analyte (or a fragment thereof)/(multiple) detection agent complex is formed. As with the capture agent (e.g., the first capture agent), when the at least one (e.g., second and any subsequent) detection agent is brought into contact with the capture agent/analyte (or a fragment thereof) complex, a period of incubation under conditions similar to those described above is required for the formation of the (first or multiple) capture agent/analyte (or a fragment thereof)/(second or multiple) detection agent complex. Preferably, at least one detection agent contains a detectable label. The detectable label can be bound to the at least one detection agent (e.g., the second detection agent) prior to, simultaneously with, or after the formation of the (first or multiple) capture agent/analyte (or a fragment thereof)/(second or multiple) detection agent complex. Any detectable label known in the art can be used (see discussion above, including of the Polak and Van Noorden (1997) and Haugland (1996) references).

The detectable label can be bound to the agents either directly or through a coupling agent. An example of a coupling agent that can be used is EDAC (1-ethyl-3-(3-dimethylaminopropyl) carbodiimide, hydrochloride), which is commercially available from Sigma-Aldrich, St. Louis, Mo. Other coupling agents that can be used are known in the art. Methods for binding a detectable label to an antibody are known in the art. Additionally, many detectable labels can be purchased or synthesized that already contain end groups that facilitate the coupling of the detectable label to the agent, such as CPSP-Acridinium Ester (i.e., 9-[N-tosyl-N-(3-carboxypropyl)]-10-(3-sulfopropyl)acridinium carboxamide) or SPSP-Acridinium Ester (i.e., N10-(3-sulfopropyl)-N-(3-sulfopropyl)-acridinium-9-carboxamide).

The (first or multiple) capture agent/analyte/(second or multiple) detection agent complex can be, but does not have to be, separated from the remainder of the test sample prior to quantification of the label. For example, if the at least one capture agent (e.g., the first capture agent, such as a binding protein and/or a DVD-Ig in accordance with the present disclosure) is bound to a solid support, such as a well or a bead, separation can be accomplished by removing the fluid (of the test sample) from contact with the solid support. Alternatively, if the at least first capture agent is bound to a solid support, it can be simultaneously contacted with the analyte-containing sample and the at least one second detection agent to form a first (multiple) agent/analyte/second (multiple) agent complex, followed by removal of the fluid (test sample) from contact with the solid support. If the at least one first capture agent is not bound to a solid support, then the (first or multiple) capture agent/analyte/(second or multiple) detection agent complex does not have to be removed from the test sample for quantification of the amount of the label.

After formation of the labeled capture agent/analyte/detection agent complex (e.g., the first capture agent/analyte/second detection agent complex), the amount of label in the complex is quantified using techniques known in the art. For example, if an enzymatic label is used, the labeled complex is reacted with a substrate for the label that gives a quantifiable reaction such as the development of color. If the label is a radioactive label, the label is quantified using appropriate means, such as a scintillation counter. If the label is a fluorescent label, the label is quantified by stimulating the label with a light of one color (which is known as the "excitation wavelength") and detecting another color (which is known as the "emission wavelength") that is emitted by the label in response to the stimulation. If the label is a chemiluminescent label, the label is quantified by detecting the light emitted either visually or by using luminometers, x-ray film, high speed photographic film, a CCD camera, etc. Once the amount of the label in the complex has been quantified, the concentration of analyte or a fragment thereof in the test sample is determined by appropriate means, such as by use of a standard curve that has been generated using serial dilutions of analyte or a fragment thereof of known concentration. Other than using serial dilutions of analyte or a fragment thereof, the standard curve can be generated gravimetrically, by mass spectroscopy and by other techniques known in the art.

In a chemiluminescent microparticle assay employing the ARCHITECT® analyzer, the conjugate diluent pH should be about 6.0+/−0.2, the microparticle coating buffer should be maintained at about room temperature (i.e., at from about 17 to about 27° C.), the microparticle coating buffer pH should be about 6.5+/−0.2, and the microparticle diluent pH should be about 7.8+/−0.2. Solids preferably are less than about 0.2%, such as less than about 0.15%, less than about 0.14%, less than about 0.13%, less than about 0.12%, or less than about 0.11%, such as about 0.10%.

FPIAs are based on competitive binding immunoassay principles. A fluorescently labeled compound, when excited by a linearly polarized light, will emit fluorescence having a degree of polarization inversely proportional to its rate of rotation. When a fluorescently labeled tracer-antibody complex is excited by a linearly polarized light, the emitted light remains highly polarized because the fluorophore is constrained from rotating between the time light is absorbed and the time light is emitted. When a "free" tracer compound (i.e., a compound that is not bound to an antibody) is excited by linearly polarized light, its rotation is much faster than the corresponding tracer-antibody conjugate (or tracer-binding protein and/or tracer-DVD-Ig in accordance with the present disclosure) produced in a competitive binding immunoassay. FPIAs are advantageous over RIAs inasmuch as there are no radioactive substances requiring special handling and disposal. In addition, FPIAs are homogeneous assays that can be easily and rapidly performed.

In view of the above, a method of determining the presence, amount, or concentration of analyte (or a fragment thereof) in a test sample is provided. The method comprises assaying the test sample for an analyte (or a fragment thereof) by an assay (i) employing (i') at least one of an antibody, a fragment of an antibody that can bind to an analyte, a variant of an antibody that can bind to an analyte, a fragment of a variant of an antibody that can bind to an analyte, a binding protein as disclosed herein, and a DVD-Ig (or a fragment, a variant, or a fragment of a variant thereof)

that can bind to an analyte, and (ii') at least one detectable label and (ii) comprising comparing a signal generated by the detectable label as a direct or indirect indication of the presence, amount or concentration of analyte (or a fragment thereof) in the test sample to a signal generated as a direct or indirect indication of the presence, amount or concentration of analyte (or a fragment thereof) in a control or calibrator. The calibrator is optionally part of a series of calibrators, in which each of the calibrators differs from the other calibrators by the concentration of analyte.

The method can comprise (i) contacting the test sample with at least one first specific binding partner for analyte (or a fragment thereof) comprising an antibody, a fragment of an antibody that can bind to an analyte, a variant of an antibody that can bind to an analyte, a fragment of a variant of an antibody that can bind to an analyte, a binding protein as disclosed herein, or a DVD-Ig (or a fragment, a variant, or a fragment of a variant thereof) that can bind to an analyte so as to form a first specific binding partner/analyte (or fragment thereof) complex, (ii) contacting the first specific binding partner/analyte (or fragment thereof) complex with at least one second specific binding partner for analyte (or fragment thereof) comprising a detectably labeled anti-analyte antibody, a detectably labeled fragment of an anti-analyte antibody that can bind to analyte, a detectably labeled variant of an anti-analyte antibody that can bind to analyte, a detectably labeled fragment of a variant of an anti-analyte antibody that can bind to analyte, a detectably labeled binding protein as disclosed herein that can bind to analyte, or a detectably labeled DVD-Ig (or a fragment, a variant, or a fragment of a variant thereof) so as to form a first specific binding partner/analyte (or fragment thereof)/ second specific binding partner complex, and (iii) determining the presence, amount or concentration of analyte in the test sample by detecting or measuring the signal generated by the detectable label in the first specific binding partner/ analyte (or fragment thereof)/second specific binding partner complex formed in (ii). A method in which at least one first specific binding partner for analyte (or a fragment thereof) and/or at least one second specific binding partner for analyte (or a fragment thereof) is a binding protein as disclosed herein or a DVD-Ig (or a fragment, a variant, or a fragment of a variant thereof) as described herein can be preferred.

Alternatively, the method can comprise contacting the test sample with at least one first specific binding partner for analyte (or a fragment thereof) comprising an antibody, a fragment of an antibody that can bind to an analyte, a variant of an antibody that can bind to an analyte, a fragment of a variant of an antibody that can bind to an analyte, a binding protein as disclosed herein, or a DVD-Ig (or a fragment, a variant, or a fragment of a variant thereof) and simultaneously or sequentially, in either order, contacting the test sample with at least one second specific binding partner, which can compete with analyte (or a fragment thereof) for binding to the at least one first specific binding partner, wherein the binding partner is a detectably labeled analyte, a detectably labeled fragment of analyte that can bind to the first specific binding partner, a detectably labeled variant of analyte that can bind to the first specific binding partner, or a detectably labeled fragment of a variant of analyte that can bind to the first specific binding partner. Any analyte (or a fragment thereof) present in the test sample and the at least one second specific binding partner compete with each other to form a first specific binding partner/analyte (or fragment thereof) complex and a first specific binding partner/second specific binding partner complex, respectively. The method further comprises determining the presence, amount or concentration of analyte in the test sample by detecting or measuring the signal generated by the detectable label in the first specific binding partner/second specific binding partner complex formed in (ii), wherein the signal generated by the detectable label in the first specific binding partner/second specific binding partner complex is inversely proportional to the amount or concentration of analyte in the test sample.

The above methods can further comprise diagnosing, prognosticating, or assessing the efficacy of a therapeutic/ prophylactic treatment of a patient from whom the test sample was obtained. If the method further comprises assessing the efficacy of a therapeutic/prophylactic treatment of the patient from whom the test sample was obtained, the method optionally further comprises modifying the therapeutic/prophylactic treatment of the patient as needed to improve efficacy. The method can be adapted for use in an automated system or a semi-automated system.

More specifically, a method of determining the presence, amount or concentration of an antigen (or a fragment thereof) in a test sample is provided. The method comprises assaying the test sample for the antigen (or a fragment thereof) by an immunoassay. The immunoassay (i) employs at least one binding protein and at least one detectable label and (ii) comprises comparing a signal generated by the detectable label as a direct or indirect indication of the presence, amount or concentration of the antigen (or a fragment thereof) in the test sample to a signal generated as a direct or indirect indication of the presence, amount or concentration of the antigen (or a fragment thereof) in a control or a calibrator. The calibrator is optionally part of a series of calibrators in which each of the calibrators differs from the other calibrators in the series by the concentration of the antigen (or a fragment thereof). One of the at least one binding protein (i') comprises a polypeptide chain comprising VD1-(X1)n-VD2-C—(X2)n, in which VD1 is a first heavy chain variable domain obtained from a first parent antibody (or antigen binding portion thereof), VD2 is a second heavy chain variable domain obtained from a second parent antibody (or antigen binding portion thereof), which can be the same as or different from the first parent antibody, C is a heavy chain constant domain, (X1)n is a linker, which is optionally present and, when present, is other than CH1, and (X2)n is an Fc region, which is optionally present, and (ii') can bind a pair of antigens. The method can comprise (i) contacting the test sample with at least one capture agent, which binds to an epitope on the antigen (or a fragment thereof) so as to form a capture agent/antigen (or a fragment thereof) complex, (ii) contacting the capture agent/antigen (or a fragment thereof) complex with at least one detection agent, which comprises a detectable label and binds to an epitope on the antigen (or a fragment thereof) that is not bound by the capture agent, to form a capture agent/antigen (or a fragment thereof)/detection agent complex, and (iii) determining the presence, amount or concentration of the antigen (or a fragment thereof) in the test sample based on the signal generated by the detectable label in the capture agent/antigen (or a fragment thereof)/detection agent complex formed in (ii), wherein at least one capture agent and/or at least one detection agent is the at least one binding protein. Alternatively, the method can comprise (i) contacting the test sample with at least one capture agent, which binds to an epitope on the antigen (or a fragment thereof) so as to form a capture agent/antigen (or a fragment thereof) complex, and simultaneously or sequentially, in either order, contacting the test sample with detectably labeled antigen (or a fragment thereof), which can compete with any antigen (or a fragment thereof) in the test sample for binding to the at least one capture agent, wherein any antigen (or a fragment thereof) present in the test sample and the detectably labeled antigen compete with each other to form a capture agent/antigen (or a fragment thereof) complex and a capture agent/detectably labeled antigen (or a fragment thereof) complex, respectively, and (ii) determining the presence, amount or concentration of the antigen (or a fragment thereof) in the test sample based on the signal generated by the detectable label in the capture agent/detectably labeled antigen (or a fragment thereof) complex formed in (ii), wherein at least one capture agent is the at least one binding protein and wherein the signal generated by the detectable label in the capture agent/detectably labeled antigen (or a fragment thereof) complex is inversely proportional to the amount or concentration of antigen (or a fragment thereof) in the test sample. The test sample can be from a patient, in which case the method can further comprise diagnosing, prognosticating, or assessing the efficacy of therapeutic/prophylactic treatment of the patient. If the method further comprises assessing the efficacy of therapeutic/prophylactic treatment of the patient, the method optionally further comprises modifying the therapeutic/prophylactic treatment of the patient as needed to improve efficacy. The method can be adapted for use in an automated system or a semi-automated system.

Another method of determining the presence, amount or concentration of an antigen (or a fragment thereof) in a test sample is provided. The method comprises assaying the test sample for the antigen (or a fragment thereof) by an immunoassay. The immunoassay (i) employs at least one binding protein and at least one detectable label and (ii) comprises comparing a signal generated by the detectable label as a direct or indirect indication of the presence, amount or concentration of the antigen (or a fragment thereof) in the test sample to a signal generated as a direct or indirect indication of the presence, amount or concentration of the antigen (or a fragment thereof) in a control or a calibrator. The calibrator is optionally part of a series of calibrators in which each of the calibrators differs from the other calibrators in the series by the concentration of the antigen (or a fragment thereof). One of the at least one binding protein (i') comprises a polypeptide chain comprising VD1-(X1)n-VD2-C—(X2)n, in which VD1 is a first light chain variable domain obtained from a first parent antibody (or antigen binding portion thereof), VD2 is a second light chain variable domain obtained from a second parent antibody (or antigen binding portion thereof), which can be the same as or different from the first parent antibody, C is a light chain constant domain, (X1)n is a linker, which is optionally present and, when present, is other than CH1, and (X2)n is an Fc region, which is optionally present, and (ii') can bind a pair of antigens. The method can comprise (i) contacting the test sample with at least one capture agent, which binds to an epitope on the antigen (or a fragment thereof) so as to form a capture agent/antigen (or a fragment thereof) complex, (ii) contacting the capture agent/antigen (or a fragment thereof) complex with at least one detection agent, which comprises a detectable label and binds to an epitope on the antigen (or a fragment thereof) that is not bound by the capture agent, to form a capture agent/antigen (or a fragment thereof)/detection agent complex, and (iii) determining the presence, amount or concentration of the antigen (or a fragment thereof) in the test sample based on the signal generated by the detectable label in the capture agent/antigen (or a fragment thereof)/detection agent complex formed in (ii), wherein at least one capture agent and/or at least one detection agent is the at least one binding protein. Alternatively, the method can comprise (i) contacting the test sample with at least one capture agent, which binds to an epitope on the antigen (or a fragment thereof) so as to form a capture agent/antigen (or a fragment thereof) complex, and simultaneously or sequentially, in either order, contacting the test sample with detectably labeled antigen (or a fragment thereof), which can compete with any antigen (or a fragment thereof) in the test sample for binding to the at least one capture agent, wherein any antigen (or a fragment thereof) present in the test sample and the detectably labeled antigen compete with each other to form a capture agent/antigen (or a fragment thereof) complex and a capture agent/detectably labeled antigen (or a fragment thereof) complex, respectively, and (ii) determining the presence, amount or concentration of the antigen (or a fragment thereof) in the test sample based on the signal generated by the detectable label in the capture agent/detectably labeled antigen (or a fragment thereof) complex formed in (ii), wherein at least one capture agent is the at least one binding protein and wherein the signal generated by the detectable label in the capture agent/detectably labeled antigen (or a fragment thereof) complex is inversely proportional to the amount or concentration of antigen (or a fragment thereof) in the test sample. If the test sample is from a patient, the method can further comprise diagnosing, prognosticating, or assessing the efficacy of therapeutic/prophylactic treatment of the patient. If the method further comprises assessing the efficacy of therapeutic/prophylactic treatment of the patient, the method optionally further comprises modifying the therapeutic/prophylactic treatment of the patient as needed to improve efficacy. The method can be adapted for use in an automated system or a semi-automated system.

Yet another method of determining the presence, amount or concentration of an antigen (or a fragment thereof) in a test sample is provided. The method comprises assaying the test sample for the antigen (or a fragment thereof) by an immunoassay. The immunoassay (i) employs at least one binding protein and at least one detectable label and (ii) comprises comparing a signal generated by the detectable label as a direct or indirect indication of the presence, amount or concentration of the antigen (or a fragment thereof) in the test sample to a signal generated as a direct or indirect indication of the presence, amount or concentration of the antigen (or a fragment thereof) in a control or a calibrator. The calibrator is optionally part of a series of calibrators in which each of the calibrators differs from the other calibrators in the series by the concentration of the antigen (or a fragment thereof). One of the at least one binding protein (i') comprises a first polypeptide chain and a second polypeptide chain, wherein the first polypeptide chain comprises a first VD1-(X1)n-VD2-C—(X2)n, in which VD1 is a first heavy chain variable domain obtained from a first parent antibody (or antigen binding portion thereof), VD2 is a second heavy chain variable domain obtained from a second parent antibody (or antigen binding portion thereof), which can be the same as or different from the first parent antibody, C is a heavy chain constant domain, (X1)n is a linker, which is optionally present and, when present, is other than CH1, and (X2)n is an Fc region, which is optionally present, and wherein the second polypeptide chain comprises a second VD1-(X1)n-VD2-C—(X2)n, in which VD1 is a first light chain variable domain obtained from a first parent antibody (or antigen binding portion thereof), VD2 is a second light chain variable domain obtained from a second parent antibody (or antigen binding portion thereof), which can be the same as or different from the first parent antibody, C is a light chain constant domain, (X1)n is a linker, which is optionally present and, when present, is other than CH1, and (X2)n is an Fc region, which is optionally present, and (ii') can bind a pair of antigens. The method can comprise (i) contacting the test sample with at least one capture agent, which binds to an epitope on the antigen (or a fragment thereof) so as to form a capture agent/antigen (or a fragment thereof) complex, (ii) contacting the capture agent/antigen (or a fragment thereof) complex with at least one detection agent, which comprises a detectable label and binds to an epitope on the antigen (or a fragment thereof) that is not bound by the capture agent, to form a capture agent/antigen (or a fragment thereof)/detection agent complex, and (iii) determining the presence, amount or concentration of the antigen (or a fragment thereof) in the test sample based on the signal generated by the detectable label in the capture agent/antigen (or a fragment thereof)/detection agent complex formed in (ii), wherein at least one capture agent and/or at least one detection agent is the at least one binding protein. Alternatively, the method can comprise (i) contacting the test sample with at least one capture agent, which binds to an epitope on the antigen (or a fragment thereof) so as to form a capture agent/antigen (or a fragment thereof) complex, and simultaneously or sequentially, in either order, contacting the test sample with detectably labeled antigen (or a fragment thereof), which can compete with any antigen (or a fragment thereof) in the test sample for binding to the at least one capture agent, wherein any antigen (or a fragment thereof) present in the test sample and the detectably labeled antigen compete with each other to form a capture agent/antigen (or a fragment thereof) complex and a capture agent/detectably labeled antigen (or a fragment thereof) complex, respectively, and (ii) determining the presence, amount or concentration of the antigen (or a fragment thereof) in the test sample based on the signal generated by the detectable label in the capture agent/detectably labeled antigen (or a fragment thereof) complex formed in (ii), wherein at least one capture agent is the at least one binding protein and wherein the signal generated by the detectable label in the capture agent/detectably labeled antigen (or a fragment thereof) complex is inversely proportional to the amount or concentration of antigen (or a fragment thereof) in the test sample. If the test sample is from a patient, the method can further comprise diagnosing, prognosticating, or assessing the efficacy of therapeutic/prophylactic treatment of the patient. If the method further comprises assessing the efficacy of therapeutic/prophylactic treatment of the patient, the method optionally further comprises modifying the therapeutic/prophylactic treatment of the patient as needed to improve efficacy. The method can be adapted for use in an automated system or a semi-automated system.

Still yet another method of determining the presence, amount or concentration of an antigen (or a fragment thereof) in a test sample is provided. The method comprises assaying the test sample for the antigen (or a fragment thereof) by an immunoassay. The immunoassay (i) employs at least one DVD-Ig that can bind two antigens and at least one detectable label and (ii) comprises comparing a signal generated by the detectable label as a direct or indirect indication of the presence, amount or concentration of the antigen (or a fragment thereof) in the test sample to a signal generated as a direct or indirect indication of the presence, amount or concentration of the antigen (or a fragment thereof) in a control or a calibrator. The calibrator is optionally part of a series of calibrators in which each of the calibrators differs from the other calibrators in the series by the concentration of the antigen (or a fragment thereof). One of the at least one DVD-Ig (i') comprises four polypeptide chains, wherein the first and third polypeptide chains comprise a first VD1-(X1)n-VD2-C—(X2)n, in which VD1 is a first heavy chain variable domain obtained from a first parent antibody (or antigen binding portion thereof), VD2 is a second heavy chain variable domain obtained from a second parent antibody (or antigen binding portion thereof), which can be the same as or different from the first parent antibody, C is a heavy chain constant domain, (X1)n is a linker, which is optionally present and, when present, is other than CH1, and (X2)n is an Fc region, which is optionally present, and wherein the second and fourth polypeptide chains comprise a second VD1-(X1)n-VD2-C—(X2)n, in which VD1 is a first light chain variable domain obtained from a first parent antibody (or antigen binding portion thereof), VD2 is a second light chain variable domain obtained from a second parent antibody (or antigen binding portion thereof), which can be the same as or different from the first parent antibody, C is a light chain constant domain, (X1)n is a linker, which is optionally present and, when present, is other than CH1, and (X2)n is an Fc region, which is optionally present, and (ii') can bind two antigens (or fragments thereof). The method can comprise (i) contacting the test sample with at least one capture agent, which binds to an epitope on the antigen (or a fragment thereof) so as to form a capture agent/antigen (or a fragment thereof) complex, (ii) contacting the capture agent/antigen (or a fragment thereof) complex with at least one detection agent, which comprises a detectable label and binds to an epitope on the antigen (or a fragment thereof) that is not bound by the capture agent, to form a capture agent/antigen (or a fragment thereof)/detection agent complex, and (iii) determining the presence, amount or concentration of the antigen (or a fragment thereof) in the test sample based on the signal generated by the detectable label in the capture agent/antigen (or a fragment thereof)/detection agent complex formed in (ii), wherein at least one capture agent and/or at least one detection agent is the at least one DVD-Ig. Alternatively, the method can comprise (i) contacting the test sample with at least one capture agent, which binds to an epitope on the antigen (or a fragment thereof) so as to form a capture agent/antigen (or a fragment thereof) complex, and simultaneously or sequentially, in either order, contacting the test sample with detectably labeled antigen (or a fragment thereof), which can compete with any antigen (or a fragment thereof) in the test sample for binding to the at least one capture agent, wherein any antigen (or a fragment thereof) present in the test sample and the detectably labeled antigen compete with each other to form a capture agent/antigen (or a fragment thereof) complex and a capture agent/detectably labeled antigen (or a fragment thereof) complex, respectively, and (ii) determining the presence, amount or concentration of the antigen (or a fragment thereof) in the test sample based on the signal generated by the detectable label in the capture agent/detectably labeled antigen (or a fragment thereof) complex formed in (ii), wherein at least one capture agent is the at least one DVD-Ig and wherein the signal generated by the detectable label in the capture agent/detectably labeled antigen (or a fragment thereof) complex is inversely proportional to the amount or concentration of antigen (or a fragment thereof) in the test sample. If the test sample is from a patient, the method can further comprise diagnosing, prognosticating, or assessing the efficacy of therapeutic/prophylactic treatment of the patient. If the method further comprises assessing the efficacy of therapeutic/prophylactic treatment of the patient, the method optionally further comprises modifying the therapeutic/prophylactic treatment of the patient as needed to improve efficacy. The method can be adapted for use in an automated system or a semi-automated system.

With regard to the methods of assay (and kit therefor), it may be possible to employ commercially available anti-analyte antibodies or methods for production of anti-analyte as described in the literature. Commercial supplies of various antibodies include, but are not limited to, Santa Cruz Biotechnology Inc. (Santa Cruz, Calif.), GenWay Biotech, Inc. (San Diego, Calif.), and R&D Systems (RDS; Minneapolis, Minn.).

Generally, a predetermined level can be employed as a benchmark against which to assess results obtained upon assaying a test sample for analyte or a fragment thereof, e.g., for detecting disease or risk of disease. Generally, in making such a comparison, the predetermined level is obtained by running a particular assay a sufficient number of times and under appropriate conditions such that a linkage or association of analyte presence, amount or concentration with a particular stage or endpoint of a disease, disorder or condition or with particular clinical indicia can be made. Typically, the predetermined level is obtained with assays of reference subjects (or populations of subjects). The analyte measured can include fragments thereof, degradation products thereof, and/or enzymatic cleavage products thereof.

In particular, with respect to a predetermined level as employed for monitoring disease progression and/or treatment, the amount or concentration of analyte or a fragment thereof may be "unchanged," "favorable" (or "favorably altered"), or "unfavorable" (or "unfavorably altered"). "Elevated" or "increased" refers to an amount or a concentration in a test sample that is higher than a typical or normal level or range (e.g., predetermined level), or is higher than another reference level or range (e.g., earlier or baseline sample). The term "lowered" or "reduced" refers to an amount or a concentration in a test sample that is lower than a typical or normal level or range (e.g., predetermined level), or is lower than another reference level or range (e.g., earlier or baseline sample). The term "altered" refers to an amount or a concentration in a sample that is altered (increased or decreased) over a typical or normal level or range (e.g., predetermined level), or over another reference level or range (e.g., earlier or baseline sample).

The typical or normal level or range for analyte is defined in accordance with standard practice. Because the levels of analyte in some instances will be very low, a so-called altered level or alteration can be considered to have occurred when there is any net change as compared to the typical or normal level or range, or reference level or range, that cannot be explained by experimental error or sample variation. Thus, the level measured in a particular sample will be compared with the level or range of levels determined in similar samples from a so-called normal subject. In this context, a "normal subject" is an individual with no detectable disease, for example, and a "normal" (sometimes termed "control") patient or population is/are one(s) that exhibit(s) no detectable disease, respectively, for example. Furthermore, given that analyte is not routinely found at a high level in the majority of the human population, a "normal subject" can be considered an individual with no substantial detectable increased or elevated amount or concentration of analyte, and a "normal" (sometimes termed "control") patient or population is/are one(s) that exhibit(s) no substantial detectable increased or elevated amount or concentration of analyte. An "apparently normal subject" is one in which analyte has not yet been or currently is being assessed. The level of an analyte is said to be "elevated" when the analyte is normally undetectable (e.g., the normal level is zero, or within a range of from about 25 to about 75 percentiles of normal populations), but is detected in a test sample, as well as when the analyte is present in the test sample at a higher than normal level. Thus, inter alia, the disclosure provides a method of screening for a subject having, or at risk of having, a particular disease, disorder, or condition. The method of assay can also involve the assay of other markers and the like.

Accordingly, the methods described herein also can be used to determine whether or not a subject has or is at risk of developing a given disease, disorder or condition. Specifically, such a method can comprise the steps of:

(a) determining the concentration or amount in a test sample from a subject of analyte (or a fragment thereof) (e.g., using the methods described herein, or methods known in the art); and (b) comparing the concentration or amount of analyte (or a fragment thereof) determined in step (a) with a predetermined level, wherein, if the concentration or amount of analyte determined in step (a) is favorable with respect to a predetermined level, then the subject is determined not to have or be at risk for a given disease, disorder or condition. However, if the concentration or amount of analyte determined in step (a) is unfavorable with respect to the predetermined level, then the subject is determined to have or be at risk for a given disease, disorder or condition.

Additionally, provided herein is method of monitoring the progression of disease in a subject. Optimally the method comprising the steps of:

(a) determining the concentration or amount in a test sample from a subject of analyte;

(b) determining the concentration or amount in a later test sample from the subject of analyte; and (c) comparing the concentration or amount of analyte as determined in step (b) with the concentration or amount of analyte determined in step (a), wherein if the concentration or amount determined in step (b) is unchanged or is unfavorable when compared to the concentration or amount of analyte determined in step (a), then the disease in the subject is determined to have continued, progressed or worsened. By comparison, if the concentration or amount of analyte as determined in step (b) is favorable when compared to the concentration or amount of analyte as determined in step (a), then the disease in the subject is determined to have discontinued, regressed or improved.

Optionally, the method further comprises comparing the concentration or amount of analyte as determined in step (b), for example, with a predetermined level. Further, optionally the method comprises treating the subject with one or more pharmaceutical compositions for a period of time if the comparison shows that the concentration or amount of analyte as determined in step (b), for example, is unfavorably altered with respect to the predetermined level.

Still further, the methods can be used to monitor treatment in a subject receiving treatment with one or more pharmaceutical compositions. Specifically, such methods involve providing a first test sample from a subject before the subject has been administered one or more pharmaceutical compositions. Next, the concentration or amount in a first test sample from a subject of analyte is determined (e.g., using the methods described herein or as known in the art). After the concentration or amount of analyte is determined, optionally the concentration or amount of analyte is then compared with a predetermined level. If the concentration or amount of analyte as determined in the first test sample is lower than the predetermined level, then the subject is not treated with one or more pharmaceutical compositions. However, if the concentration or amount of analyte as determined in the first test sample is higher than the predetermined level, then the subject is treated with one or more pharmaceutical compositions for a period of time. The period of time that the subject is treated with the one or more pharmaceutical compositions can be determined by one skilled in the art (for example, the period of time can be from about seven (7) days to about two years, preferably from about fourteen (14) days to about one (1) year).

During the course of treatment with the one or more pharmaceutical compositions, second and subsequent test samples are then obtained from the subject. The number of test samples and the time in which said test samples are obtained from the subject are not critical. For example, a second test sample could be obtained seven (7) days after the subject is first administered the one or more pharmaceutical compositions, a third test sample could be obtained two (2) weeks after the subject is first administered the one or more pharmaceutical compositions, a fourth test sample could be obtained three (3) weeks after the subject is first administered the one or more pharmaceutical compositions, a fifth test sample could be obtained four (4) weeks after the subject is first administered the one or more pharmaceutical compositions, etc.

After each second or subsequent test sample is obtained from the subject, the concentration or amount of analyte is determined in the second or subsequent test sample is determined (e.g., using the methods described herein or as known in the art). The concentration or amount of analyte as determined in each of the second and subsequent test samples is then compared with the concentration or amount of analyte as determined in the first test sample (e.g., the test sample that was originally optionally compared to the predetermined level). If the concentration or amount of analyte as determined in step (c) is favorable when compared to the concentration or amount of analyte as determined in step (a), then the disease in the subject is determined to have discontinued, regressed or improved, and the subject should continue to be administered the one or pharmaceutical compositions of step (b). However, if the concentration or amount determined in step (c) is unchanged or is unfavorable when compared to the concentration or amount of analyte as determined in step (a), then the disease in the subject is determined to have continued, progressed or worsened, and the subject should be treated with a higher concentration of the one or more pharmaceutical compositions administered to the subject in step (b) or the subject should be treated with one or more pharmaceutical compositions that are different from the one or more pharmaceutical compositions administered to the subject in step (b). Specifically, the subject can be treated with one or more pharmaceutical compositions that are different from the one or more pharmaceutical compositions that the subject had previously received to decrease or lower said subject's analyte level.

Generally, for assays in which repeat testing may be done (e.g., monitoring disease progression and/or response to treatment), a second or subsequent test sample is obtained at a period in time after the first test sample has been obtained from the subject. Specifically, a second test sample from the subject can be obtained minutes, hours, days, weeks or years after the first test sample has been obtained from the subject. For example, the second test sample can be obtained from the subject at a time period of about 1 minute, about 5 minutes, about 10 minutes, about 15 minutes, about 30 minutes, about 45 minutes, about 60 minutes, about 2 hours, about 3 hours, about 4 hours, about 5 hours, about 6 hours, about 7 hours, about 8 hours, about 9 hours, about 10 hours, about 11 hours, about 12 hours, about 13 hours, about 14 hours, about 15 hours, about 16 hours, about 17 hours, about 18 hours, about 19 hours, about 20 hours, about 21 hours, about 22 hours, about 23 hours, about 24 hours, about 2 days, about 3 days, about 4 days, about 5 days, about 6 days, about 7 days, about 2 weeks, about 3 weeks, about 4 weeks, about 5 weeks, about 6 weeks, about 7 weeks, about 8 weeks, about 9 weeks, about 10 weeks, about 11 weeks, about 12 weeks, about 13 weeks, about 14 weeks, about 15 weeks, about 16 weeks, about 17 weeks, about 18 weeks, about 19 weeks, about 20 weeks, about 21 weeks, about 22 weeks, about 23 weeks, about 24 weeks, about 25 weeks, about 26 weeks, about 27 weeks, about 28 weeks, about 29 weeks, about 30 weeks, about 31 weeks, about 32 weeks, about 33 weeks, about 34 weeks, about 35 weeks, about 36 weeks, about 37 weeks, about 38 weeks, about 39 weeks, about 40 weeks, about 41 weeks, about 42 weeks, about 43 weeks, about 44 weeks, about 45 weeks, about 46 weeks, about 47 weeks, about 48 weeks, about 49 weeks, about 50 weeks, about 51 weeks, about 52 weeks, about 1.5 years, about 2 years, about 2.5 years, about 3.0 years, about 3.5 years, about 4.0 years, about 4.5 years, about 5.0 years, about 5.5. years, about 6.0 years, about 6.5 years, about 7.0 years, about 7.5 years, about 8.0 years, about 8.5 years, about 9.0 years, about 9.5 years or about 10.0 years after the first test sample from the subject is obtained.

When used to monitor disease progression, the above assay can be used to monitor the progression of disease in subjects suffering from acute conditions. Acute conditions, also known as critical care conditions, refer to acute, life-threatening diseases or other critical medical conditions involving, for example, the cardiovascular system or excretory system. Typically, critical care conditions refer to those conditions requiring acute medical intervention in a hospital-based setting (including, but not limited to, the emergency room, intensive care unit, trauma center, or other emergent care setting) or administration by a paramedic or other field-based medical personnel. For critical care conditions, repeat monitoring is generally done within a shorter time frame, namely, minutes, hours or days (e.g., about 1 minute, about 5 minutes, about 10 minutes, about 15 minutes, about 30 minutes, about 45 minutes, about 60 minutes, about 2 hours, about 3 hours, about 4 hours, about 5 hours, about 6 hours, about 7 hours, about 8 hours, about 9 hours, about 10 hours, about 11 hours, about 12 hours, about 13 hours, about 14 hours, about 15 hours, about 16 hours, about 17 hours, about 18 hours, about 19 hours, about 20 hours, about 21 hours, about 22 hours, about 23 hours, about 24 hours, about 2 days, about 3 days, about 4 days, about 5 days, about 6 days or about 7 days), and the initial assay likewise is generally done within a shorter timeframe, e.g., about minutes, hours or days of the onset of the disease or condition.

The assays also can be used to monitor the progression of disease in subjects suffering from chronic or non-acute conditions. Non-critical care or, non-acute conditions, refers to conditions other than acute, life-threatening disease or other critical medical conditions involving, for example, the cardiovascular system and/or excretory system. Typically, non-acute conditions include those of longer-term or chronic duration. For non-acute conditions, repeat monitoring generally is done with a longer timeframe, e.g., hours, days, weeks, months or years (e.g., about 1 hour, about 2 hours, about 3 hours, about 4 hours, about 5 hours, about 6 hours, about 7 hours, about 8 hours, about 9 hours, about 10 hours, about 11 hours, about 12 hours, about 13 hours, about 14 hours, about 15 hours, about 16 hours, about 17 hours, about 18 hours, about 19 hours, about 20 hours, about 21 hours, about 22 hours, about 23 hours, about 24 hours, about 2 days, about 3 days, about 4 days, about 5 days, about 6 days, about 7 days, about 2 weeks, about 3 weeks, about 4 weeks, about 5 weeks, about 6 weeks, about 7 weeks, about 8 weeks, about 9 weeks, about 10 weeks, about 11 weeks, about 12 weeks, about 13 weeks, about 14 weeks, about 15 weeks, about 16 weeks, about 17 weeks, about 18 weeks, about 19 weeks, about 20 weeks, about 21 weeks, about 22 weeks, about 23 weeks, about 24 weeks, about 25 weeks, about 26 weeks, about 27 weeks, about 28 weeks, about 29 weeks, about 30 weeks, about 31 weeks, about 32 weeks, about 33 weeks, about 34 weeks, about 35 weeks, about 36 weeks, about 37 weeks, about 38 weeks, about 39 weeks, about 40 weeks, about 41 weeks, about 42 weeks, about 43 weeks, about 44 weeks, about 45 weeks, about 46 weeks, about 47 weeks, about 48 weeks, about 49 weeks, about 50 weeks, about 51 weeks, about 52 weeks, about 1.5 years, about 2 years, about 2.5 years, about 3.0 years, about 3.5 years, about 4.0 years, about 4.5 years, about 5.0 years, about 5.5. years, about 6.0 years, about 6.5 years, about 7.0 years, about 7.5 years, about 8.0 years, about 8.5 years, about 9.0 years, about 9.5 years or about 10.0 years), and the initial assay likewise generally is done within a longer time frame, e.g., about hours, days, months or years of the onset of the disease or condition.

Furthermore, the above assays can be performed using a first test sample obtained from a subject where the first test sample is obtained from one source, such as urine, serum or plasma. Optionally, the above assays can then be repeated using a second test sample obtained from the subject where the second test sample is obtained from another source. For example, if the first test sample was obtained from urine, the second test sample can be obtained from serum or plasma. The results obtained from the assays using the first test sample and the second test sample can be compared. The comparison can be used to assess the status of a disease or condition in the subject.

Moreover, the present disclosure also relates to methods of determining whether a subject predisposed to or suffering from a given disease, disorder or condition will benefit from treatment. In particular, the disclosure relates to analyte companion diagnostic methods and products. Thus, the method of "monitoring the treatment of disease in a subject" as described herein further optimally also can encompass selecting or identifying candidates for therapy.

Thus, in particular embodiments, the disclosure also provides a method of determining whether a subject having, or at risk for, a given disease, disorder or condition is a candidate for therapy. Generally, the subject is one who has experienced some symptom of a given disease, disorder or condition or who has actually been diagnosed as having, or being at risk for, a given disease, disorder or condition, and/or who demonstrates an unfavorable concentration or amount of analyte or a fragment thereof, as described herein.

The method optionally comprises an assay as described herein, where analyte is assessed before and following treatment of a subject with one or more pharmaceutical compositions (e.g., particularly with a pharmaceutical related to a mechanism of action involving analyte), with immunosuppressive therapy, or by immunoabsorption therapy, or where analyte is assessed following such treatment and the concentration or the amount of analyte is compared against a predetermined level. An unfavorable concentration of amount of analyte observed following treatment confirms that the subject will not benefit from receiving further or continued treatment, whereas a favorable concentration or amount of analyte observed following treatment confirms that the subject will benefit from receiving further or continued treatment. This confirmation assists with management of clinical studies, and provision of improved patient care.

It goes without saying that, while certain embodiments herein are advantageous when employed to assess a given disease, disorder or condition as discussed herein, the assays and kits can be employed to assess analyte in other diseases, disorders and conditions. The method of assay can also involve the assay of other markers and the like.

The method of assay also can be used to identify a compound that ameliorates a given disease, disorder or condition. For example, a cell that expresses analyte can be contacted with a candidate compound. The level of expression of analyte in the cell contacted with the compound can be compared to that in a control cell using the method of assay described herein.

B. Kit

A kit for assaying a test sample for the presence, amount or concentration of an analyte (or a fragment thereof) in a test sample is also provided. The kit comprises at least one component for assaying the test sample for the analyte (or a fragment thereof) and instructions for assaying the test sample for the analyte (or a fragment thereof). The at least one component for assaying the test sample for the analyte (or a fragment thereof) can include a composition comprising a binding protein as disclosed herein and/or an anti-analyte DVD-Ig (or a fragment, a variant, or a fragment of a variant thereof), which is optionally immobilized on a solid phase.

The kit can comprise at least one component for assaying the test sample for an analyte by immunoassay, e.g., chemiluminescent microparticle immunoassay, and instructions for assaying the test sample for an analyte by immunoassay, e.g., chemiluminescent microparticle immunoassay. For example, the kit can comprise at least one specific binding partner for an analyte, such as an anti-analyte, monoclonal/polyclonal antibody (or a fragment thereof that can bind to the analyte, a variant thereof that can bind to the analyte, or a fragment of a variant that can bind to the analyte) a binding protein as disclosed herein or an anti-analyte DVD-Ig (or a fragment, a variant, or a fragment of a variant thereof), either of which can be detectably labeled. Alternatively or additionally, the kit can comprise detectably labeled analyte (or a fragment thereof that can bind to an anti-analyte, monoclonal/polyclonal antibody a binding protein as disclosed herein, or an anti-analyte DVD-Ig (or a fragment, a variant, or a fragment of a variant thereof)), which can compete with any analyte in a test sample for binding to an anti-analyte, monoclonal/polyclonal antibody (or a fragment thereof that can bind to the analyte, a variant thereof that can bind to the analyte, or a fragment of a variant that can bind to the analyte), a binding protein as disclosed herein, or an anti-analyte DVD-Ig (or a fragment, a variant, or a fragment of a variant thereof), either of which can be immobilized on a solid support. The kit can comprise a calibrator or control, e.g., isolated or purified analyte. The kit can comprise at least one container (e.g., tube, microtiter plates or strips, which can be already coated with a first specific binding partner, for example) for conducting the assay, and/or a buffer, such as an assay buffer or a wash buffer, either one of which can be provided as a concentrated solution, a substrate solution for the detectable label (e.g., an enzymatic label), or a stop solution. Preferably, the kit comprises all components, i.e., reagents, standards, buffers, diluents, etc., which are necessary to perform the assay. The instructions can be in paper form or computer-readable form, such as a disk, CD, DVD, or the like.

More specifically, provided is a kit for assaying a test sample for an antigen (or a fragment thereof). The kit comprises at least one component for assaying the test sample for an antigen (or a fragment thereof) and instructions for assaying the test sample for an antigen (or a fragment thereof), wherein the at least one component includes at least one composition comprising a binding protein, which (i') comprises a polypeptide chain comprising VD1-(X1)n-VD2-C—(X2)n, in which VD1 is a first heavy chain variable domain obtained from a first parent antibody (or antigen binding portion thereof), VD2 is a second heavy chain variable domain obtained from a second parent antibody (or antigen binding portion thereof), which can be same as or different from the first parent antibody, C is a heavy chain constant domain, (X1)n is a linker, which is optionally present and, when present, is other than CH1, and (X2)n is an Fc region, which is optionally present, and (ii') can bind a pair of antigens, wherein the binding protein is optionally detectably labeled.

Further provided is another kit for assaying a test sample for an antigen (or a fragment thereof). The kit comprises at least one component for assaying the test sample for an antigen (or a fragment thereof) and instructions for assaying the test sample for an antigen (or a fragment thereof), wherein the at least one component includes at least one composition comprising a binding protein, which (i') comprises a polypeptide chain comprising VD1-(X1)n-VD2-C—(X2)n, in which VD1 is a first light chain variable domain obtained from a first parent antibody (or antigen binding portion thereof), VD2 is a second light chain variable domain obtained from a second parent antibody (or antigen binding portion thereof), which can be the same as or different from the first parent antibody, C is a light chain constant domain, (X1)n is a linker, which is optionally present and, when present, is other than CH1, and (X2)n is an Fc region, which is optionally present, and (ii') can bind a pair of antigens, wherein the binding protein is optionally detectably labeled.

Still further provided is another kit for assaying a test sample for an antigen (or a fragment thereof). The kit comprises at least one component for assaying the test sample for an antigen (or a fragment thereof) and instructions for assaying the test sample for an antigen (or a fragment thereof), wherein the at least one component includes at least one composition comprising a binding protein, which (i') comprises a first polypeptide chain and a second polypeptide chain, wherein the first polypeptide chain comprises a first VD1-(X1)n-VD2-C—(X2)n, in which VD1 is a first heavy chain variable domain obtained from a first parent antibody (or antigen binding portion thereof), VD2 is a second heavy chain variable domain obtained from a second parent antibody (or antigen binding portion thereof), which can be the same as or different from the first parent antibody, C is a heavy chain constant domain, (X1)n is a linker, which is optionally present and, when present, is other than CH1, and (X2)n is an Fc region, which is optionally present, and wherein the second polypeptide chain comprises a second VD1-(X1)n-VD2-C—(X2)n, in which VD1 is a first light chain variable domain obtained from a first parent antibody (or antigen binding portion thereof), VD2 is a second light chain variable domain obtained from a second parent antibody (or antigen binding portion thereof), which can be the same as or different from the first parent antibody, C is a light chain constant domain, (X1)n is a linker, which is optionally present and, when present, is other than CH1, and (X2)n is an Fc region, which is optionally present, and (ii') can bind a pair of antigens, wherein the binding protein is optionally detectably labeled.

Even still further provided is another kit for assaying a test sample for an antigen (or a fragment thereof). The kit comprises at least one component for assaying the test sample for an antigen (or a fragment thereof) and instructions for assaying the test sample for an antigen (or a fragment thereof), wherein the at least one component includes at least one composition comprising a DVD-Ig, which (i') comprises four polypeptide chains, wherein the first and third polypeptide chains comprise a first VD1-(X1)n-VD2-C—(X2)n, in which VD1 is a first heavy chain variable domain obtained from a first parent antibody (or antigen binding portion thereof), VD2 is a second heavy chain variable domain obtained from a second parent antibody (or antigen binding portion thereof), which can be the same as or different from the first parent antibody, C is a heavy chain constant domain, (X1)n is a linker, which is optionally present and, when present, is other than CH1, and (X2)n is an Fc region, which is optionally present, and wherein the second and fourth polypeptide chains comprise a second VD1-(X1)n-VD2-C—(X2)n, in which VD1 is a first light chain variable domain obtained from a first parent antibody (or antigen binding portion thereof), VD2 is a second light chain variable domain obtained from a second parent antibody (or antigen binding portion thereof), which can be the same as or different from the first parent antibody, C is a light chain constant domain, (X1)n is a linker, which is optionally present and, when present, is other than CH1, and (X2)n is an Fc region, which is optionally present, and (ii') can bind two antigens (or fragments thereof), wherein the DVD-Ig is optionally detectably labeled.

Any antibodies, such as an anti-analyte antibody, any binding proteins as disclosed herein, any anti-analyte DVD-Igs, or tracers can incorporate a detectable label as described herein, such as a fluorophore, a radioactive moiety, an enzyme, a biotin/avidin label, a chromophore, a chemiluminescent label, or the like, or the kit can include reagents for carrying out detectable labeling. The antibodies, calibrators and/or controls can be provided in separate containers or pre-dispensed into an appropriate assay format, for example, into microtiter plates.

Optionally, the kit includes quality control components (for example, sensitivity panels, calibrators, and positive controls). Preparation of quality control reagents is well-known in the art and is described on insert sheets for a variety of immunodiagnostic products. Sensitivity panel members optionally are used to establish assay performance characteristics, and further optionally are useful indicators of the integrity of the immunoassay kit reagents, and the standardization of assays.

The kit can also optionally include other reagents required to conduct a diagnostic assay or facilitate quality control evaluations, such as buffers, salts, enzymes, enzyme co-factors, enzyme substrates, detection reagents, and the like. Other components, such as buffers and solutions for the isolation and/or treatment of a test sample (e.g., pretreatment reagents), also can be included in the kit. The kit can additionally include one or more other controls. One or more of the components of the kit can be lyophilized, in which case the kit can further comprise reagents suitable for the reconstitution of the lyophilized components.

The various components of the kit optionally are provided in suitable containers as necessary, e.g., a microtiter plate. The kit can further include containers for holding or storing a sample (e.g., a container or cartridge for a urine sample). Where appropriate, the kit optionally also can contain reaction vessels, mixing vessels, and other components that facilitate the preparation of reagents or the test sample. The kit can also include one or more instruments for assisting with obtaining a test sample, such as a syringe, pipette, forceps, measured spoon, or the like.

If the detectable label is at least one acridinium compound, the kit can comprise at least one acridinium-9-carboxamide, at least one acridinium-9-carboxylate aryl ester, or any combination thereof. If the detectable label is at least one acridinium compound, the kit also can comprise a source of hydrogen peroxide, such as a buffer, a solution, and/or at least one basic solution. If desired, the kit can contain a solid phase, such as a magnetic particle, bead, test tube, microtiter plate, cuvette, membrane, scaffolding molecule, film, filter paper, disc or chip.

C. Adaptation of Kit and Method

The kit (or components thereof), as well as the method of determining the presence, amount or concentration of an analyte in a test sample by an assay, such as an immunoassay as described herein, can be adapted for use in a variety of automated and semi-automated systems (including those wherein the solid phase comprises a microparticle), as described, e.g., in U.S. Pat. Nos. 5,089,424 and 5,006,309, and as commercially marketed, e.g., by Abbott Laboratories (Abbott Park, Ill.) as ARCHITECT®.

Some of the differences between an automated or semi-automated system as compared to a non-automated system (e.g., ELISA) include the substrate to which the first specific binding partner (e.g., an anti-analyte, monoclonal/polyclonal antibody (or a fragment thereof, a variant thereof, or a fragment of a variant thereof), a binding protein as disclosed herein, or an anti-analyte DVD-Ig (or a fragment thereof, a variant thereof, or a fragment of a variant thereof) is attached; either way, sandwich formation and analyte reactivity can be impacted), and the length and timing of the capture, detection and/or any optional wash steps. Whereas a non-automated format, such as an ELISA, may require a relatively longer incubation time with sample and capture reagent (e.g., about 2 hours), an automated or semi-automated format (e.g., ARCHITECT®, Abbott Laboratories) may have a relatively shorter incubation time (e.g., approximately 18 minutes for ARCHITECT®). Similarly, whereas a non-automated format, such as an ELISA, may incubate a detection antibody, such as the conjugate reagent, for a relatively longer incubation time (e.g., about 2 hours), an automated or semi-automated format (e.g., ARCHITECT®) may have a relatively shorter incubation time (e.g., approximately 4 minutes for the ARCHITECT®).

Other platforms available from Abbott Laboratories include, but are not limited to, AxSYM®, IMx® (see, e.g., U.S. Pat. No. 5,294,404), PRISM®, EIA (bead), and Quantum™ II, as well as other platforms. Additionally, the assays, kits and kit components can be employed in other formats, for example, on electrochemical or other hand-held or point-of-care assay systems. The present disclosure is, for example, applicable to the commercial Abbott Point of Care (i-STAT®, Abbott Laboratories) electrochemical immunoassay system that performs sandwich immunoassays. Immunosensors and their methods of manufacture and operation in single-use test devices are described, for example in, U.S. Pat. Nos. 5,063,081; 7,419,821; and 7,682,833; and U.S. Patent Publication Nos. 20040018577 and 20060160164.

In particular, with regard to the adaptation of an analyte assay to the I-STAT® system, the following configuration is preferred. A microfabricated silicon chip is manufactured with a pair of gold amperometric working electrodes and a silver-silver chloride reference electrode. On one of the working electrodes, polystyrene beads (0.2 mm diameter) with immobilized anti-analyte, monoclonal/polyclonal antibody (or a fragment thereof, a variant thereof, or a fragment of a variant thereof), a binding protein as disclosed herein, or anti-analyte DVD-Ig (or a fragment thereof, a variant thereof, or a fragment of a variant thereof), are adhered to a polymer coating of patterned polyvinyl alcohol over the electrode. This chip is assembled into an I-STAT® cartridge with a fluidics format suitable for immunoassay. On a portion of the wall of the sample-holding chamber of the cartridge there is a layer comprising a specific binding partner for an analyte, such as an anti-analyte, monoclonal/polyclonal antibody (or a fragment thereof, a variant thereof, or a fragment of a variant thereof that can bind the analyte), a binding protein as disclosed herein, or an anti-analyte DVD-Ig (or a fragment thereof, a variant thereof, or a fragment of a variant thereof that can bind the analyte), either of which can be detectably labeled. Within the fluid pouch of the cartridge is an aqueous reagent that includes p-aminophenol phosphate.

In operation, a sample suspected of containing an analyte is added to the holding chamber of the test cartridge, and the cartridge is inserted into the I-STAT®reader. After the specific binding partner for an analyte has dissolved into the sample, a pump element within the cartridge forces the sample into a conduit containing the chip. Here it is oscillated to promote formation of the sandwich. In the penultimate step of the assay, fluid is forced out of the pouch and into the conduit to wash the sample off the chip and into a waste chamber. In the final step of the assay, the alkaline phosphatase label reacts with p-aminophenol phosphate to cleave the phosphate group and permit the liberated p-aminophenol to be electrochemically oxidized at the working electrode. Based on the measured current, the reader is able to calculate the amount of analyte in the sample by means of an embedded algorithm and factory-determined calibration curve.

It further goes without saying that the methods and kits as described herein necessarily encompass other reagents and methods for carrying out the immunoassay. For instance, encompassed are various buffers such as are known in the art and/or which can be readily prepared or optimized to be employed, e.g., for washing, as a conjugate diluent, microparticle diluent, and/or as a calibrator diluent. An exemplary conjugate diluent is ARCHITECT® conjugate diluent employed in certain kits (Abbott Laboratories, Abbott Park, Ill.) and containing 2-(N-morpholino)ethanesulfonic acid (MES), a salt, a protein blocker, an antimicrobial agent, and a detergent. An exemplary calibrator diluent is ARCHITECT® human calibrator diluent employed in certain kits (Abbott Laboratories, Abbott Park, Ill.), which comprises a buffer containing MES, other salt, a protein blocker, and an antimicrobial agent. Additionally, as described in U.S. Patent Application No. 61/142,048 filed Dec. 31, 2008, improved signal generation may be obtained, e.g., in an I-Stat cartridge format, using a nucleic acid sequence linked to the signal antibody as a signal amplifier.

EXEMPLIFICATION

It will be readily apparent to those skilled in the art that other suitable modifications and adaptations of the methods described herein are obvious and may be made using suitable equivalents without departing from the scope or the embodiments disclosed herein. Having now described several embodiments in detail, the same will be more clearly understood by reference to the following examples, which are included for purposes of illustration only and are not intended to be limiting of the claims.

EXAMPLES

Example 1

Design, Construction, and Analysis of a DVD-Ig

Example 1.1

Assays Used to Identify and Characterize Parent Antibodies and DVD-Ig

The following assays are used throughout the Examples to identify and characterize parent antibodies and DVD-Ig, unless otherwise stated.

Example 1.1.1

Assays Used to Determine Binding and Affinity of Parent Antibodies and DVD-Ig for their Target Antigen(s)

Example 1.1.1A

Direct Bind ELISA

Enzyme Linked Immunosorbent Assays to screen for antibodies that bind a desired target antigen are performed as follows. High bind ELISA plates (Corning Costar #3369, Acton, Mass.) are coated with 1004/well of 10 µg/ml of desired target antigen (R&D Systems, Minneapolis, Minn.) or desired target antigen extra-cellular domain/FC fusion protein (R&D Systems, Minneapolis, Minn.) or monoclonal mouse anti-polyHistidine antibody (R&D Systems #MAB050, Minneapolis, Minn.) in phosphate buffered saline (10×PBS, Abbott Bioresearch Center, Media Prep#MPS-073, Worcester, Mass.) overnight at 4° C. Plates are washed four times with PBS containing 0.02% Tween 20. Plates are blocked by the addition of 300 µL/well blocking solution (non-fat dry milk powder, various retail suppliers, diluted to 2% in PBS) for ½ hour at room temperature. Plates are washed four times after blocking with PBS containing 0.02% Tween 20.

Alternatively, one hundred microliters per well of 10 µg/ml of Histidine (His) tagged desired target antigen (R&D Systems, Minneapolis, Minn.) are added to ELISA plates coated with monoclonal mouse anti-polyHistidine antibody as described above and incubated for 1 hour at room temperature. Wells are washed four times with PBS containing 0.02% Tween 20.

One hundred microliters of antibody or DVD-Ig preparations diluted in blocking solution as described above is added to the desired target antigen plate or desired target antigen/FC fusion plate or the anti-polyHistidine antibody/His tagged desired target antigen plate prepared as described above and incubated for 1 hour at room temperature. Wells are washed four times with PBS containing 0.02% Tween 20.

One hundred microliters of 10 ng/mL goat anti-human IgG-FC specific HRP conjugated antibody (Southern Biotech #2040-05, Birmingham, Ala.) is added to each well of the desired target antigen plate or anti-polyHistidine antibody/Histidine tagged desired target antigen plate. Alternatively, one hundred microliters of 10 ng/mL goat anti-human IgG-kappa light chain specific HRP conjugated antibody (Southern Biotech #2060-05 Birmingham, Ala.) is added to each well of the desired target antigen/FC fusion plate and incubated for 1 hour at room temperature. Plates are washed 4 times with PBS containing 0.02% Tween 20.

One hundred microliters of enhanced TMB solution (Neogen Corp. #308177, K Blue, Lexington, Ky.) is added to each well and incubated for 10 minutes at room temperature. The reaction is stopped by the addition of 50 µL 1N sulphuric acid. Plates are read spectrophotometrically at a wavelength of 450 nm.

Example 1.1.1.B

Capture ELISA

ELISA plates (Nunc, MaxiSorp, Rochester, N.Y.) are incubated overnight at 4° C. with anti-human Fc antibody (5 µg/ml in PBS, Jackson Immunoresearch, West Grove, Pa.). Plates are washed three times in washing buffer (PBS containing 0.05% Tween 20), and blocked for 1 hour at 25° C. in blocking buffer (PBS containing 1% BSA). Wells are washed three times, and serial dilutions of each antibody or DVD-Ig in PBS containing 0.1% BSA are added to the wells and incubated at 25° C. for 1 hour. The wells are washed three times, and biotinylated antigen (2 nM) is added to the plates and incubated for 1 hour at 25° C. The wells are three times, and then incubated for 1 hour at 25° C. with streptavidin-HRP (KPL #474-3000, Gaithersburg, Md.). The wells are washed three times, and 100 µl of ULTRA-TMB ELISA (Pierce, Rockford, Ill.) are added per well. Following color development the reaction is stopped with 1N HCL and absorbance at 450 nM is measured.

Example 1.1.1.C

IgG-Fc Capture ELISA 96-well Nunc-Immuno plates are coated with 2 µg/mL goat-anti-human IgG Fc specific antibody (Jackson Immunoresearch #109-055-098, West Grove, Pa., 50 µL/well) in PBS (Gibco #10010-023 from Invitrogen, Grand Island, N.Y.), and incubated overnight at 4° C. Plates are washed three times with washing buffer (PBS, 0.05% Tween 20) and subsequently blocked with 100 uL/well of blocking buffer (PBS, 2% BSA) for one hour at room temperature. Plates are washed three times and incubated with 50 µL/well of a 1 µg/mL solution of the appropriate antibody or DVD-Ig for one hour at room temperature. After the one hour incubation, the plates are washed three times and incubated with 50 µL/well of his-tagged, recombinant antigen protein (R&D Systems, Minneapolis, Minn., 1000 nM to 0 nM final dose range) for one hour at room temperature. Plates are washed three times, and 50 µL/well of a rabbit-anti-His tag-HRP antibody (Abcam ab1187, Cambridge, Mass., diluted at 1:10,000 in 2% BSA/PBS solution) is added and plates are incubated at room temperature for one hour. After the final wash, 50 µl/well of TMB substrate (Pierce #34028, Rockford, Ill.) is added, and the reaction is terminated after five minutes using 50 µl/well of 2N H2SO4. The absorbance is read at 450 nm (Spectra Max Plus plate reader, Molecular Devices, Sunnyvale, Calif.). EC50s are calculated in GraphPad Prism 4.03.

Example 1.1.1.D

Affinity Determination Using BIACORE Technology

TABLE 3

| Reagent Used in Biacore Analyses | | | | |
|---|---|---|---|---|
| Assay | Antigen | Vendor Designation | Vendor | Catalog # |
| | IL-1β | Recombinant Human IL-1β | R&D systems | 201-LB |
| | IL-17 | Recombinant Human IL-17 | R&D systems | 317-IL |

BIACORE Methods:

The BIACORE assay (Biacore, Inc, Piscataway, N.J.) determines the affinity of antibodies or DVD-Ig with kinetic measurements of on-rate and off-rate constants. Binding of antibodies or DVD-Ig to a target antigen (for example, a purified recombinant target antigen) was determined by surface plasmon resonance-based measurements with a Biacore® 1000 or 3000 instrument (Biacore® AB, Uppsala, Sweden) using running HBS-EP (10 mM HEPES [pH 7.4], 150 mM NaCl, 3 mM EDTA, and 0.005% surfactant P20) at 25° C. All chemicals were obtained from Biacore® AB (Uppsala, Sweden) or otherwise from a different source as described in the text. For example, approximately 5000 RU of goat anti-mouse IgG, (Fcγ), fragment specific polyclonal antibody (Pierce Biotechnology Inc, Rockford, Ill.) diluted in 10 mM sodium acetate (pH 4.5) was directly immobilized across a CM5 research grade biosensor chip using a standard amine coupling kit according to manufacturer's instructions and procedures at 25 μg/ml. Unreacted moieties on the biosensor surface were blocked with ethanolamine. Modified carboxymethyl dextran surface in flowcell 2 and 4 was used as a reaction surface. Unmodified carboxymethyl dextran without goat anti-mouse IgG in flow cell 1 and 3 was used as the reference surface. For kinetic analysis, rate equations derived from the 1:1 Langmuir binding model were fitted simultaneously to association and dissociation phases of all eight injections (using global fit analysis) with the use of Biaevaluation 4.0.1 software. Purified antibodies or DVD-Ig were diluted in HEPES-buffered saline for capture across goat anti-mouse IgG specific reaction surfaces. Antibodies or DVD-Ig to be captured as a ligand (25 μg/ml) were injected over reaction matrices at a flow rate of 5 μl/min. The association and dissociation rate constants, $k_{on}$ ($M^{-1}s^{-1}$) and $k_{off}$ ($s^{-1}$) were determined under a continuous flow rate of 25 μl/min. Rate constants were derived by making kinetic binding measurements at different antigen concentrations ranging from 10-200 nM. The equilibrium dissociation constant (M) of the reaction between antibodies or DVD-Igs and the target antigen was then calculated from the kinetic rate constants by the following formula: $K_D=k_{off}/k_{on}$. Binding was recorded as a function of time and kinetic rate constants are calculated. In this assay, on-rates as fast as $10^6 M^{-1}s^{-1}$ and off-rates as slow as $10^{-6} s^{-1}$ can be measured.

TABLE 4

| BIACORE Analysis of Parental Antibodies and DVD Constructs | | | | | |
|---|---|---|---|---|---|
| Parent Antibody or DVD-Ig ID | N-Terminal Variable Domain (VD) | C-Terminal Variable Domain (VD) | $k_{on}$ (M-1s-1) | $k_{off}$ (s-1) | $K_D$ (M) |
| AB268 | IL-1B (seq. 1) | | 9.80E+05 | 4.20E−05 | 4.30E−11 |
| AB273 | IL-17 (seq. 1) | | 7.30E+04 | 1.00E−05 | 1.40E−10 |
| DVD1262 | IL-1B (seq. 1) | | 1.40E+06 | 4.80E−05 | 3.30E−11 |
| DVD1262 | | IL-17 (seq. 1) | 8.50E+03 | 1.00E−04 | 1.20E−08 |
| DVD1263 | IL-17 (seq. 1) | | 1.30E+05 | 7.80E−06 | 6.10E−11 |
| DVD1263 | | IL-1B (seq. 1) | 8.90E+05 | 1.50E−04 | 1.70E−10 |
| AB269 | IL-1B (seq. 2) | | 6.50E+05 | 4.60E−05 | 7.10E−11 |
| AB273 | IL-17 (seq. 1) | | 7.30E+04 | 1.00E−05 | 1.40E−10 |
| DVD1264 | IL-1B (seq. 2) | | 9.40E+05 | 2.20E−05 | 2.40E−11 |
| DVD1264 | | IL-17 (seq. 1) | 3.70E+04 | 1.10E−05 | 3.00E−10 |
| DVD1265 | IL-17 (seq. 1) | | 1.20E+05 | 1.10E−05 | 9.60E−11 |
| DVD1265 | | IL-1B (seq. 2) | 3.40E+06 | 3.00E−04 | 8.80E−11 |
| AB270 | IL-1B (seq. 1) | | 6.50E+06 | 5.80E−04 | 8.90E−11 |
| AB273 | IL-17 (seq. 1) | | 7.30E+04 | 1.00E−05 | 1.40E−10 |
| DVD1266 | IL-1B (seq. 1) | | 6.00E+06 | 4.60E−04 | 7.70E−11 |
| DVD1266 | | IL-17 (seq. 1) | — | — | — |
| DVD1267 | IL-17 (seq. 1) | | 1.50E+05 | 1.00E−05 | 6.60E−11 |
| DVD1267 | | IL-1B (seq. 1) | 3.70E+05 | 4.10E−04 | 1.10E−09 |
| AB271 | IL-1B (seq. 4) | | 5.10E+06 | 5.50E−04 | 1.10E−10 |
| AB273 | IL-17 (seq. 1) | | 7.30E+04 | 1.00E−05 | 1.40E−10 |
| DVD1268 | IL-1B (seq. 4) | | 8.50E+06 | 5.70E−04 | 6.70E−11 |
| DVD1268 | | IL-17 (seq. 1) | 5.10E+04 | <1E−06 | <2.0E−11 |
| DVD1269 | IL-17 (seq. 1) | | 1.60E+05 | 5.00E−06 | 3.20E−11 |
| DVD1269 | | IL-1B (seq. 4) | 4.00E+05 | 4.30E−04 | 1.10E−09 |
| AB272 | IL-1B (seq. 5) | | 3.90E+06 | 5.30E−04 | 1.40E−10 |
| AB273 | IL-17 (seq. 1) | | 7.30E+04 | 1.00E−05 | 1.40E−10 |
| DVD1270 | IL-1B (seq. 5) | | 5.30E+06 | 5.40E−04 | 1.00E−10 |
| DVD1270 | | IL-17 (seq. 1) | — | — | — |
| DVD1271 | IL-17 (seq. 1) | | 1.10E+05 | 1.20E−05 | 1.10E−10 |
| DVD1271 | | IL-1B (seq. 5) | 3.20E+05 | 7.10E−04 | 2.20E−09 |
| AB268 | IL-1B (seq. 1) | | 9.80E+05 | 4.20E−05 | 4.30E−11 |
| AB274 | IL-17 (seq. 2) | | 5.50E+04 | 2.00E−05 | 3.60E−10 |
| DVD1272 | IL-1B (seq. 1) | | 1.50E+06 | 4.50E−05 | 3.00E−11 |
| DVD1272 | | IL-17 (seq. 2) | — | — | — |
| DVD1273 | IL-17 (seq. 2) | | 1.10E+05 | 2.20E−05 | 2.00E−10 |

TABLE 4-continued

BIACORE Analysis of Parental Antibodies and DVD Constructs

| Parent Antibody or DVD-Ig ID | N-Terminal Variable Domain (VD) | C-Terminal Variable Domain (VD) | $k_{on}$ (M$^{-1}$s$^{-1}$) | $k_{off}$ (s$^{-1}$) | $K_D$ (M) |
|---|---|---|---|---|---|
| DVD1273 | | IL-1B (seq. 1) | 6.90E+05 | 1.90E−04 | 2.70E−10 |
| AB269 | | IL-1B (seq. 1) | 6.50E+05 | 4.60E−05 | 7.10E−11 |
| AB274 | | IL-17 (seq. 2) | 5.50E+04 | 2.00E−05 | 3.60E−10 |
| DVD1274 | IL-1B (seq. 2) | | 1.30E+06 | 4.00E−05 | 3.10E−11 |
| DVD1274 | | IL-17 (seq. 2) | — | — | — |
| DVD1275 | IL-17 (seq. 2) | | 1.40E+05 | 2.10E−05 | 1.50E−10 |
| DVD1275 | | IL-1B (seq. 2) | 7.60E+05 | 1.10E−04 | 1.50E−10 |
| AB270 | | IL-1B (seq. 3) | 6.50E+06 | 5.80E−04 | 8.90E−11 |
| AB274 | | IL-17 (seq. 2) | 5.50E+04 | 2.00E−05 | 3.60E−10 |
| DVD1276 | IL-1B (seq. 3) | | 5.60E+06 | 4.50E−04 | 8.20E−11 |
| DVD1276 | | IL-17 (seq. 2) | — | — | — |
| DVD1277 | IL-17 (seq. 2) | | 1.30E+05 | 2.20E−05 | 1.60E−10 |
| DVD1277 | | IL-1B (seq. 3) | 2.30E+05 | 4.90E−04 | 2.10E−09 |
| AB271 | | IL-1B (seq. 4) | 5.10E+06 | 5.50E−04 | 1.10E−10 |
| AB274 | | IL-17 (seq. 2) | 5.50E+04 | 2.00E−05 | 3.60E−10 |
| DVD1278 | IL-1B (seq. 4) | | 6.90E+06 | 4.70E−04 | 6.90E−11 |
| DVD1278 | | IL-17 (seq. 2) | — | — | — |
| DVD1279 | IL-17 (seq. 2) | | 1.90E+05 | 2.30E−05 | 1.20E−10 |
| DVD1279 | | IL-1B (seq. 4) | 3.20E+05 | 4.50E−04 | 1.40E−09 |
| AB272 | | IL-1B (seq. 5) | 3.90E+06 | 5.30E−04 | 1.40E−10 |
| AB274 | | IL-17 (seq. 2) | 5.50E+04 | 2.00E−05 | 3.60E−10 |
| DVD1280 | IL-1B (seq. 5) | | 7.90E+06 | 6.30E−04 | 8.00E−11 |
| DVD1280 | | IL-17 (seq. 2) | — | — | — |
| DVD1281 | IL-17 (seq. 2) | | 2.00E+05 | 2.00E−05 | 1.00E−10 |
| DVD1281 | | IL-1B (seq. 5) | 2.80E+05 | 5.80E−04 | 2.00E−09 |
| AB268 | | IL-1B (seq. 1) | 9.80E+05 | 4.20E−05 | 4.30E−11 |
| AB275 | | IL-17 (seq. 3) | 2.80E+03 | 2.40E−05 | 8.80E−09 |
| DVD1282 | IL-1B (seq. 1) | | 1.70E+06 | 7.20E−05 | 4.30E−11 |
| DVD1282 | | IL-17 (seq. 3) | — | — | — |
| DVD1283 | IL-17 (seq. 3) | | 1.30E+05 | 5.80E−05 | 4.60E−10 |
| DVD1283 | | IL-1B (seq. 1) | 2.50E+06 | 2.60E−04 | 1.00E−10 |
| AB269 | | IL-1B (seq. 1) | 6.50E+05 | 4.60E−05 | 7.10E−11 |
| AB275 | | IL-17 (seq. 3) | 2.80E+03 | 2.40E−05 | 8.80E−09 |
| DVD1284 | IL-1B (seq. 2) | | 1.10E+06 | 1.90E−05 | 1.70E−11 |
| DVD1284 | | IL-17 (seq. 3) | — | — | — |
| DVD1285 | IL-17 (seq. 3) | | 1.50E+05 | 5.80E−05 | 3.90E−10 |
| DVD1285 | | IL-1B (seq. 2) | 8.20E+05 | 2.00E−04 | 2.40E−10 |
| AB270 | | IL-1B (seq. 3) | 6.50E+06 | 5.80E−04 | 8.90E−11 |
| AB275 | | IL-17 (seq. 3) | 2.80E+03 | 2.40E−05 | 8.80E−09 |
| DVD1286 | IL-1B (seq. 3) | | 7.20E+06 | 5.00E−04 | 7.00E−11 |
| DVD1286 | | IL-17 (seq. 3) | — | — | — |
| DVD1287 | IL-17 (seq. 3) | | 1.60E+05 | 4.70E−05 | 3.00E−10 |
| DVD1287 | | IL-1B (seq. 3) | 3.10E+05 | 3.70E−04 | 1.20E−09 |
| AB271 | | IL-1B (seq. 4) | 5.10E+06 | 5.50E−04 | 1.10E−10 |
| AB275 | | IL-17 (seq. 3) | 2.80E+03 | 2.40E−05 | 8.80E−09 |
| DVD1288 | IL-1B (seq. 4) | | 6.10E+06 | 4.60E−04 | 7.60E−11 |
| DVD1288 | | IL-17 (seq. 3) | — | — | — |
| DVD1289 | IL-17 (seq. 3) | | 1.40E+05 | 5.60E−05 | 4.00E−10 |
| DVD1289 | | IL-1B (seq. 4) | 3.70E+05 | 4.80E−04 | 1.30E−09 |
| AB272 | | IL-1B (seq. 5) | 3.90E+06 | 5.30E−04 | 1.40E−10 |
| AB275 | | IL-17 (seq. 3) | 2.80E+03 | 2.40E−05 | 8.80E−09 |
| DVD1290 | IL-1B (seq. 5) | | 7.50E+06 | 6.50E−04 | 8.60E−11 |
| DVD1290 | | IL-17 (seq. 3) | — | — | — |
| DVD1291 | IL-17 (seq. 3) | | 1.20E+04 | 6.00E−07 | 4.80E−11 |
| DVD1291 | | IL-1B (seq. 5) | 2.10E+05 | 5.80E−04 | 2.80E−09 |
| AB268 | | IL-1B (seq. 1) | 1.20E+06 | 4.10E−05 | 3.40E−11 |
| AB273 | | IL-17 (seq. 1) | 2.80E+06 | 1.20E−05 | 4.10E−12 |
| DVD1590 | IL-17 (seq. 1) | | 3.80E+06 | 7.00E−06 | 1.80E−12 |
| DVD1590 | | IL-1B (seq. 1) | 2.50E+05 | 4.60E−05 | 1.90E−10 |
| AB269 | | IL-1B (seq. 2) | 7.80E+05 | 4.10E−05 | 5.30E−11 |
| AB273 | | IL-17 (seq. 1) | 2.80E+06 | 1.20E−05 | 4.10E−12 |
| DVD1591 | IL-1B (seq. 2) | | 9.60E+05 | 3.10E−05 | 3.20E−11 |
| DVD1591 | | IL-17 (seq. 1) | 3.10E+05 | <1e−06 | 1.00E−12 |
| DVD1592 | IL-17 (seq. 1) | | 3.20E+06 | 2.00E−05 | 6.40E−12 |
| DVD1592 | | IL-1B (seq. 2) | 6.90E+05 | 4.90E−06 | 7.20E−12 |
| AB270 | | IL-1B (seq. 1) | 6.70E+06 | 5.50E−04 | 8.20E−11 |
| AB273 | | IL-17 (seq. 1) | 2.80E+06 | 1.20E−05 | 4.10E−12 |
| DVD1593 | IL-1B (seq. 1) | | 7.40E+06 | 4.70E−04 | 6.40E−11 |
| DVD1593 | | IL-17 (seq. 1) | 3.40E+05 | 9.20E−06 | 2.70E−11 |
| DVD1594 | IL-17 (seq. 1) | | 4.20E+06 | 2.30E−05 | 5.60E−12 |
| DVD1594 | | IL-1B (seq. 1) | 7.10E+05 | 4.30E−04 | 6.00E−10 |
| AB271 | | IL-1B (seq. 4) | 6.00E+06 | 5.70E−04 | 9.60E−11 |
| AB273 | | IL-17 (seq. 1) | 2.80E+06 | 1.20E−05 | 4.10E−12 |

TABLE 4-continued

BIACORE Analysis of Parental Antibodies and DVD Constructs

| Parent Antibody or DVD-Ig ID | N-Terminal Variable Domain (VD) | C-Terminal Variable Domain (VD) | $k_{on}$ (M-1s-1) | $k_{off}$ (s-1) | $K_D$ (M) |
|---|---|---|---|---|---|
| DVD1595 | IL-1B (seq. 4) | | 7.40E+06 | 4.10E-04 | 5.50E-11 |
| DVD1595 | | IL-17 (seq. 1) | 1.40E+06 | 6.00E-06 | 4.30E-12 |
| DVD1596 | IL-17 (seq. 1) | | 4.10E+06 | 1.30E-05 | 3.30E-12 |
| DVD1596 | | IL-1B (seq. 4) | 7.00E+05 | 3.60E-04 | 5.10E-10 |
| AB272 | IL-1B (seq. 5) | | 5.30E+06 | 6.60E-04 | 1.20E-10 |
| AB273 | IL-17 (seq. 1) | | 2.80E+06 | 1.20E-05 | 4.10E-12 |
| DVD1597 | IL-1B (seq. 5) | | 8.40E+06 | 6.30E-04 | 7.50E-11 |
| DVD1597 | | IL-17 (seq. 1) | 3.50E+05 | 4.10E-06 | 1.20E-11 |
| DVD1598 | IL-17 (seq. 1) | | 3.50E+06 | 1.80E-05 | 5.10E-12 |
| DVD1598 | | IL-1B (seq. 5) | 6.30E+06 | 7.40E-04 | 1.20E-09 |
| AB268 | IL-1B (seq. 1) | | 1.20E+06 | 4.10E-05 | 3.40E-11 |
| AB274 | IL-17 (seq. 2) | | 2.70E+06 | 2.10E-05 | 7.60E-12 |
| DVD1599 | IL-1B (seq. 1) | | 2.00E+06 | 4.10E-05 | 2.10E-11 |
| DVD1599 | | IL-17 (seq. 2) | 1.20E+05 | <1e-06 | 7.40E-14 |
| DVD1600 | IL-17 (seq. 2) | | 2.80E+06 | <1e-06 | 3.80E-12 |
| DVD1600 | | IL-1B (seq. 1) | 1.70E+05 | 9.40E-05 | 5.50E-10 |
| AB269 | IL-1B (seq. 1) | | 7.80E+05 | 4.10E-05 | 5.30E-11 |
| AB274 | IL-17 (seq. 2) | | 2.70E+06 | 2.10E-05 | 7.60E-12 |
| DVD1601 | IL-1B (seq. 2) | | 1.20E+06 | 2.00E-05 | 1.60E-11 |
| DVD1601 | | IL-17 (seq. 2) | 1.20E+05 | <1e-06 | 1.20E-13 |
| DVD1602 | IL-17 (seq. 2) | | 2.70E+06 | 1.40E-05 | 5.10E-12 |
| DVD1602 | | IL-1B (seq. 2) | 1.30E+05 | 2.30E-05 | 1.80E-10 |
| AB270 | IL-1B (seq. 3) | | 6.70E+06 | 5.50E-04 | 8.20E-11 |
| AB274 | IL-17 (seq. 2) | | 2.70E+06 | 2.10E-05 | 7.60E-12 |
| DVD1603 | IL-1B (seq. 3) | | 6.90E+06 | 4.80E-04 | 6.90E-11 |
| DVD1603 | | IL-17 (seq. 2) | 3.10E+05 | <1e-06 | 2.70E-13 |
| DVD1604 | IL-17 (seq. 2) | | 3.80E+06 | 9.70E-06 | 2.60E-12 |
| DVD1604 | | IL-1B (seq. 3) | 1.30E+06 | 3.70E-04 | 2.90E-10 |
| AB271 | IL-1B (seq. 4) | | 6.00E+06 | 5.70E-04 | 9.60E-11 |
| AB274 | IL-17 (seq. 2) | | 2.70E+06 | 2.10E-05 | 7.60E-12 |
| DVD1605 | IL-1B (seq. 4) | | 8.60E+06 | 5.00E-04 | 5.90E-11 |
| DVD1605 | | IL-17 (seq. 2) | 4.10E+05 | <1e-06 | 6.80E-14 |
| DVD1606 | IL-17 (seq. 2) | | 4.40E+06 | 3.00E-06 | 6.70E-13 |
| DVD1606 | | IL-1B (seq. 4) | 1.40E+06 | 4.40E-04 | 3.20E-10 |
| AB272 | IL-1B (seq. 5) | | 5.30E+06 | 6.60E-04 | 1.20E-10 |
| AB274 | IL-17 (seq. 2) | | 2.70E+06 | 2.10E-05 | 7.60E-12 |
| DVD1608 | IL-17 (seq. 2) | | 4.80E+06 | 1.20E-05 | 2.60E-12 |
| DVD1608 | | IL-1B (seq. 5) | 1.50E+06 | 5.60E-04 | 3.70E-10 |
| AB268 | IL-1B (seq. 1) | | 1.20E+06 | 4.10E-05 | 3.40E-11 |
| AB275 | IL-17 (seq. 3) | | 4.20E+06 | 8.10E-05 | 1.90E-11 |
| DVD1609 | IL-1B (seq. 1) | | 2.10E+06 | 4.60E-05 | 2.20E-11 |
| DVD1609 | | IL-17 (seq. 3) | 8.90E+04 | <1e-06 | 8.40E-13 |
| DVD1610 | IL-17 (seq. 3) | | 3.50E+06 | 5.70E-05 | 1.70E-11 |
| DVD1610 | | IL-1B (seq. 1) | 2.90E+05 | 7.30E-05 | 2.50E-10 |
| AB269 | IL-1B (seq. 1) | | 7.80E+05 | 4.10E-05 | 5.30E-11 |
| AB275 | IL-17 (seq. 3) | | 4.20E+06 | 8.10E-05 | 1.90E-11 |
| DVD1611 | IL-1B (seq. 2) | | 3.10E+05 | 1.30E-04 | 4.20E-10 |
| DVD1611 | | IL-17 (seq. 3) | 4.10E+06 | 6.00E-05 | 1.50E-11 |
| DVD1612 | IL-17 (seq. 3) | | 3.20E+06 | 5.10E-05 | 1.60E-11 |
| DVD1612 | | IL-1B (seq. 2) | 1.60E+05 | 2.50E-05 | 1.50E-10 |
| AB270 | IL-1B (seq. 3) | | 6.70E+06 | 5.50E-04 | 8.20E-11 |
| AB275 | IL-17 (seq. 3) | | 4.20E+06 | 8.10E-05 | 1.90E-11 |
| DVD1613 | IL-1B (seq. 3) | | 7.80E+06 | 4.60E-04 | 5.90E-11 |
| DVD1613 | | IL-17 (seq. 3) | 3.60E+05 | <1e-06 | 1.50E-13 |
| DVD1614 | IL-17 (seq. 3) | | 3.50E+06 | 4.80E-05 | 1.40E-11 |
| DVD1614 | | IL-1B (seq. 3) | 1.70E+06 | 3.00E-04 | 1.80E-10 |
| AB271 | IL-1B (seq. 4) | | 6.00E+06 | 5.70E-04 | 9.60E-11 |
| AB275 | IL-17 (seq. 3) | | 4.20E+06 | 8.10E-05 | 1.90E-11 |
| DVD1615 | IL-1B (seq. 4) | | 9.90E+06 | 5.50E-04 | 5.50E-11 |
| DVD1615 | | IL-17 (seq. 3) | 3.90E+05 | 6.00E-05 | 1.50E-10 |
| DVD1616 | IL-17 (seq. 3) | | 3.30E+06 | 4.90E-05 | 1.50E-11 |
| DVD1616 | | IL-1B (seq. 4) | 1.60E+06 | 3.60E-04 | 2.20E-10 |
| AB272 | IL-1B (seq. 5) | | 5.30E+06 | 6.60E-04 | 1.20E-10 |
| AB275 | IL-17 (seq. 3) | | 4.20E+06 | 8.10E-05 | 1.90E-11 |
| DVD1618 | IL-17 (seq. 3) | | 3.20E+06 | 6.30E-05 | 1.90E-11 |
| DVD1618 | | IL-1B (seq. 5) | 2.40E+06 | 6.20E-04 | 2.60E-10 |
| AB268 | IL-1B (seq. 1) | | 8.90E+05 | 2.10E-04 | 2.40E-10 |
| AB273 | IL-17 (seq. 1) | | 2.70E+06 | 1.30E-05 | 4.60E-12 |
| DVD1620 | IL-17 (seq. 1) | | 3.80E+06 | 7.10E-06 | 1.90E-12 |
| DVD1620 | | IL-1B (seq. 1) | 3.30E+05 | 9.40E-05 | 2.90E-10 |
| AB269 | IL-1B (seq. 2) | | 5.40E+05 | 1.10E-04 | 2.00E-10 |
| AB273 | IL-17 (seq. 1) | | 2.70E+06 | 1.30E-05 | 4.60E-12 |
| DVD1622 | IL-17 (seq. 1) | | 3.70E+06 | 1.70E-06 | 4.60E-13 |

TABLE 4-continued

BIACORE Analysis of Parental Antibodies and DVD Constructs

| Parent Antibody or DVD-Ig ID | N-Terminal Variable Domain (VD) | C-Terminal Variable Domain (VD) | $k_{on}$ (M-1s-1) | $k_{off}$ (s-1) | $K_D$ (M) |
|---|---|---|---|---|---|
| DVD1622 | | IL-1B (seq. 2) | 1.50E+06 | 2.30E−04 | 1.60E−10 |
| AB270 | IL-1B (seq. 1) | | 6.60E+06 | 5.30E−04 | 8.00E−11 |
| AB273 | IL-17 (seq. 1) | | 2.70E+06 | 1.30E−05 | 4.60E−12 |
| DVD1623 | IL-1B (seq. 1) | | 6.60E+06 | 4.90E−04 | 7.50E−11 |
| DVD1623 | | IL-17 (seq. 1) | 2.30E+05 | <1e−06 | 3.40E−14 |
| DVD1624 | IL-17 (seq. 1) | | 3.70E+06 | 4.10E−05 | 1.10E−11 |
| DVD1624 | | IL-1B (seq. 1) | 5.50E+05 | 4.60E−04 | 8.40E−10 |
| AB271 | IL-1B (seq. 4) | | 4.60E+06 | 5.10E−04 | 1.10E−10 |
| AB273 | IL-17 (seq. 1) | | 2.70E+06 | 1.30E−05 | 4.60E−12 |
| DVD1625 | IL-1B (seq. 4) | | 8.60E+06 | 5.40E−04 | 6.30E−11 |
| DVD1625 | | IL-17 (seq. 1) | 6.30E+05 | 3.20E−06 | 5.10E−12 |
| DVD1626 | IL-17 (seq. 1) | | 4.80E+06 | 1.60E−05 | 3.40E−12 |
| DVD1626 | | IL-1B (seq. 4) | 4.70E+05 | 4.70E−04 | 1.00E−09 |
| AB272 | IL-1B (seq. 5) | | 4.00E+06 | 5.60E−04 | 1.40E−10 |
| AB273 | IL-17 (seq. 1) | | 2.70E+06 | 1.30E−05 | 4.60E−12 |
| DVD1627 | IL-1B (seq. 5) | | 6.80E+06 | 5.90E−04 | 8.60E−11 |
| DVD1627 | | IL-17 (seq. 1) | 2.00E+05 | 1.70E−06 | 8.40E−12 |
| DVD1628 | IL-17 (seq. 1) | | 4.00E+06 | 2.20E−05 | 5.50E−12 |
| DVD1628 | | IL-1B (seq. 5) | 4.90E+05 | 4.90E−04 | 1.00E−09 |
| AB268 | IL-1B (seq. 1) | | 8.90E+05 | 2.10E−04 | 2.40E−10 |
| AB274 | IL-17 (seq. 2) | | 2.70E+06 | 1.80E−05 | 6.80E−12 |
| DVD1629 | IL-1B (seq. 1) | | 1.90E+06 | 7.30E−05 | 3.90E−11 |
| DVD1629 | | IL-17 (seq. 2) | 1.40E+06 | <1e−06 | 1.10E−13 |
| DVD1630 | IL-17 (seq. 2) | | 3.40E+06 | 1.60E−05 | 4.50E−12 |
| DVD1630 | | IL-1B (seq. 1) | 1.70E+05 | 7.60E−05 | 4.50E−10 |
| AB269 | IL-1B (seq. 1) | | 5.40E+05 | 1.10E−04 | 2.00E−10 |
| AB274 | IL-17 (seq. 2) | | 2.70E+06 | 1.80E−05 | 6.80E−12 |
| DVD1631 | IL-1B (seq. 2) | | 1.30E+06 | 2.20E−05 | 1.70E−11 |
| DVD1631 | | IL-17 (seq. 2) | 2.50E+05 | <1e−06 | 1.40E−13 |
| DVD1632 | IL-17 (seq. 2) | | 3.20E+06 | 1.60E−05 | 5.00E−12 |
| DVD1632 | | IL-1B (seq. 2) | 1.10E+05 | 4.70E−05 | 4.20E−10 |
| AB270 | IL-1B (seq. 3) | | 6.60E+06 | 5.30E−04 | 8.00E−11 |
| AB274 | IL-17 (seq. 2) | | 2.70E+06 | 1.80E−05 | 6.80E−12 |
| DVD1633 | IL-1B (seq. 3) | | 9.00E+06 | 5.70E−04 | 6.30E−11 |
| DVD1633 | | IL-17 (seq. 2) | 1.60E+05 | <1e−06 | 3.70E−14 |
| DVD1634 | IL-17 (seq. 2) | | 3.70E+06 | 1.90E−05 | 5.20E−12 |
| DVD1634 | | IL-1B (seq. 3) | 8.70E+05 | 5.50E−04 | 6.30E−10 |
| AB271 | IL-1B (seq. 4) | | 4.60E+06 | 5.10E−04 | 1.10E−10 |
| AB274 | IL-17 (seq. 2) | | 2.70E+06 | 1.80E−05 | 6.80E−12 |
| DVD1635 | IL-1B (seq. 4) | | 7.60E+06 | 4.50E−04 | 6.00E−11 |
| DVD1635 | | IL-17 (seq. 2) | 3.60E+05 | 4.90E−05 | 1.40E−10 |
| DVD1636 | IL-17 (seq. 2) | | 4.10E+06 | 1.90E−05 | 4.60E−12 |
| DVD1636 | | IL-1B (seq. 4) | 1.00E+06 | 6.30E−04 | 6.00E−10 |
| AB272 | IL-1B (seq. 5) | | 4.00E+06 | 5.60E−04 | 1.40E−10 |
| AB274 | IL-17 (seq. 2) | | 2.70E+06 | 1.80E−05 | 6.80E−12 |
| DVD1637 | IL-1B (seq. 5) | | 7.90E+06 | 5.90E−04 | 7.50E−11 |
| DVD1637 | | IL-17 (seq. 2) | 2.30E+05 | <1e−06 | 2.50E−12 |
| DVD1638 | IL-17 (seq. 2) | | 3.90E+06 | 2.70E−05 | 6.80E−12 |
| DVD1638 | | IL-1B (seq. 5) | 1.30E+06 | 8.50E−04 | 6.30E−10 |
| AB268 | IL-1B (seq. 1) | | 8.90E+05 | 2.10E−04 | 2.40E−10 |
| AB275 | IL-17 (seq. 3) | | 4.70E+06 | 8.50E−05 | 1.80E−11 |
| DVD1639 | IL-1B (seq. 1) | | 1.20E+06 | 5.60E−05 | 4.50E−11 |
| DVD1639 | | IL-17 (seq. 3) | 3.70E+05 | 1.00E−06 | 2.80E−12 |
| DVD1640 | IL-17 (seq. 3) | | 3.80E+06 | 6.50E−05 | 1.70E−11 |
| DVD1640 | | IL-1B (seq. 1) | 1.30E+05 | 1.20E−05 | 9.00E−11 |
| AB269 | IL-1B (seq. 1) | | 5.40E+05 | 1.10E−04 | 2.00E−10 |
| AB275 | IL-17 (seq. 3) | | 4.70E+06 | 8.50E−05 | 1.80E−11 |
| DVD1641 | IL-1B (seq. 2) | | 1.00E+06 | 1.90E−05 | 1.80E−11 |
| DVD1641 | | IL-17 (seq. 3) | 8.40E+04 | 2.20E−05 | 2.70E−10 |
| DVD1642 | IL-17 (seq. 3) | | 3.90E+06 | 4.10E−05 | 1.10E−11 |
| DVD1642 | | IL-1B (seq. 2) | 9.60E+05 | <1e−06 | <1E−12 |
| AB270 | IL-1B (seq. 3) | | 6.60E+06 | 5.30E−04 | 8.00E−11 |
| AB275 | IL-17 (seq. 3) | | 4.70E+06 | 8.50E−05 | 1.80E−11 |
| DVD1643 | IL-1B (seq. 3) | | 6.50E+06 | 4.80E−04 | 7.40E−11 |
| DVD1643 | | IL-17 (seq. 3) | 1.80E+05 | 9.40E−05 | 5.20E−10 |
| AB271 | IL-1B (seq. 4) | | 4.60E+06 | 5.10E−04 | 1.10E−10 |
| AB275 | IL-17 (seq. 3) | | 4.70E+06 | 8.50E−05 | 1.80E−11 |
| DVD1645 | IL-1B (seq. 4) | | 7.00E+06 | 5.60E−04 | 8.00E−11 |
| DVD1645 | | IL-17 (seq. 3) | 1.20E+05 | 8.10E−05 | 6.50E−10 |
| DVD1646 | IL-17 (seq. 3) | | 3.90E+06 | 4.70E−05 | 1.20E−11 |
| DVD1646 | | IL-1B (seq. 4) | 1.00E+06 | 6.30E−04 | 6.20E−10 |
| AB272 | IL-1B (seq. 5) | | 4.00E+06 | 5.60E−04 | 1.40E−10 |
| AB275 | IL-17 (seq. 3) | | 4.70E+06 | 8.50E−05 | 1.80E−11 |

TABLE 4-continued

BIACORE Analysis of Parental Antibodies and DVD Constructs

| Parent Antibody or DVD-Ig ID | N-Terminal Variable Domain (VD) | C-Terminal Variable Domain (VD) | $k_{on}$ (M-1s-1) | $k_{off}$ (s-1) | $K_D$ (M) |
|---|---|---|---|---|---|
| DVD1647 | IL-1B (seq. 5) | | 7.10E+06 | 5.90E-04 | 8.30E-11 |
| DVD1647 | | IL-17 (seq. 3) | 1.70E+05 | 9.00E-05 | 5.30E-10 |
| DVD1648 | IL-17 (seq. 3) | | 3.10E+06 | 6.20E-05 | 2.00E-11 |
| DVD1648 | | IL-1B (seq. 5) | 1.30E+06 | 7.50E-04 | 5.60E-10 |

Binding of all DVD-Ig constructs characterized by Biacore technology was maintained and comparable to that of parent antibodies. All N-terminal variable domains bound with a similar high affinity as the parent antibody.

Example 1.1.2

Assays Used to Determine the Functional Activity of Parent Antibodies and DVD-Ig Example 1.1.2.A Cytokine Bioassay The ability of an anti-cytokine or an anti-growth factor parent antibody or DVD-Ig containing anti-cytokine or anti-growth factor sequences to inhibit or neutralize a target cytokine or growth factor bioactivity is analyzed by determining the inhibitory potential of the antibody or DVD-Ig. For example, the ability of an anti-IL-4 antibody to inhibit IL-4 mediated IgE production may be used. For example, human naive B cells are isolated from peripheral blood, respectively, buffy coats by Ficoll-paque density centrifugation, followed by magnetic separation with MACS beads (Miltenyi Biotec, Bergisch Gladbach, Germany) specific for human sIgD FITC labeled goat F(ab)2 antibodies followed by anti-FITC MACS beads. Magnetically sorted naive B cells are adjusted to $3 \times 10^5$ cells per ml in XV15 and plated out in 100 µl per well of 96-well plates in a 6×6 array in the center of the plate, surrounded by PBS filled wells during the 10 days of culture at 37° C. in the presence of 5% $CO_2$. One plate each is prepared per antibody to be tested, consisting of 3 wells each of un-induced and induced controls and quintuplicate repeats of antibody titrations starting at 7 µg/ml and running in 3-fold dilution down to 29 ng/ml final concentrations added in 50 µl four times concentrated predilution. To induce IgE production, rhIL-4 at 20 ng/ml plus anti-CD40 monoclonal antibody (Novartis, Basel, Switzerland) at 0.5 µg/ml final concentrations in 50 µl each are added to each well, and IgE concentrations are determined at the end of the culture period by a standard sandwich ELISA method.

Example 1.1.2.B

Cytokine Release Assay

The ability of a parent antibody or DVD-Ig to cause cytokine release is analyzed. Peripheral blood is withdrawn from three healthy donors by venipuncture into heparized vacutainer tubes. Whole blood is diluted 1:5 with RPMI-1640 medium and placed in 24-well tissue culture plates at 0.5 mL per well. The anti-cytokine antibodies (e.g., anti-IL-4) are diluted into RPMI-1640 and placed in the plates at 0.5 mL/well to give final concentrations of 200, 100, 50, 10, and 1 µg/mL. The final dilution of whole blood in the culture plates is 1:10. LPS and PHA are added to separate wells at 2 µg/mL and 5 µg/mL final concentration as a positive control for cytokine release. Polyclonal human IgG is used as negative control antibody. The experiment is performed in duplicate. Plates are incubated at 37° C. at 5% $CO_2$. Twenty-four hours later the contents of the wells are transferred into test tubes and spun for 5 minutes at 1200 rpm. Cell-free supernatants are collected and frozen for cytokine assays. Cells left over on the plates and in the tubes are lysed with 0.5 mL of lysis solution, and placed at −20° C. and thawed. 0.5 mL of medium is added (to bring the volume to the same level as the cell-free supernatant samples) and the cell preparations are collected and frozen for cytokine assays. Cell-free supernatants and cell lysates are assayed for cytokine levels by ELISA, for example, for levels of IL-8, IL-6, IL-1β, IL-1 RA, or TNF-α.

Example 1.1.2.C

Cytokine Cross-Reactivity Study

The ability of an anti-cytokine parent antibody or DVD-Ig directed to a cytokine(s) of interest to cross react with other cytokines is analyzed. Parent antibodies or DVD-Ig are immobilized on a Biacore biosensor matrix. An anti-human Fc mAb is covalently linked via free amine groups to the dextran matrix by first activating carboxyl groups on the matrix with 100 mM N-hydroxysuccinimide (NHS) and 400 mM N-Ethyl-N'-(3-dimethylaminopropyl)-carbodiimide hydrochloride (EDC). Approximately 50 µL of each antibody or DVD-Ig preparation at a concentration of 25 µg/mL, diluted in sodium acetate, pH 4.5, is injected across the activated biosensor and free amines on the protein are bound directly to the activated carboxyl groups. Typically, 5000 Resonance Units (RU's) are immobilized. Unreacted matrix EDC-esters are deactivated by an injection of 1 M ethanolamine. A second flow cell is prepared as a reference standard by immobilizing human IgG1/K using the standard amine coupling kit. SPR measurements are performed using the CM biosensor chip. All antigens to be analyzed on the biosensor surface are diluted in HBS-EP running buffer containing 0.01% P20.

To examine the cytokine binding specificity, excess cytokine of interest (100 nM, e.g., soluble recombinant human) is injected across the anti-cytokine parent antibody or DVD-Ig immobilized biosensor surface (5 minute contact time). Before injection of the cytokine of interest and immediately afterward, HBS-EP buffer alone flows through each flow cell. The net difference in the signals between the baseline and the point corresponding to approximately 30 seconds after completion of cytokine injection are taken to represent the final binding value. Again, the response is measured in Resonance Units. Biosensor matrices are regenerated using 10 mM HCl before injection of the next sample where a binding event is observed, otherwise running buffer is injected over the matrices. Human cytokines (e.g., IL-1α, IL-1β, IL-2, IL-3, IL-4, IL-5, IL-6, IL-7, IL-8, IL-9, IL-10, IL-11, IL-12, IL-13, IL-15, IL-16, IL-17, IL-18, IL-19, IL-20, IL-22, IL-23, IL-27, TNF-α, TNF-β, and IFN-γ, for example) are also simultaneously injected over the immobilized mouse IgG1/K reference surface to record any non-specific binding background. By preparing a reference and reaction surface, Biacore can automatically subtract the reference surface data from the reaction surface data in order to eliminate the majority of the refractive index change and injection noise. Thus, it is possible to ascertain the true binding response attributed to an anti-cytokine antibody or DVD-Ig binding reaction.

When a cytokine of interest is injected across immobilized anti-cytokine antibody, significant binding is observed. 10 mM HCl regeneration completely removes all non-covalently associated proteins. Examination of the sensorgram shows that immobilized anti-cytokine antibody or DVD-Ig binding to soluble cytokine is strong and robust. After confirming the expected result with the cytokine of interest, the panel of remaining recombinant human cytokines is tested, for each antibody or DVD-Ig separately. The amount of anti-cytokine antibody or DVD-Ig bound or unbound cytokine for each injection cycle is recorded. The results from three independent experiments are used to determine the specificity profile of each antibody or DVD-Ig. Antibodies or DVD-Ig with the expected binding to the cytokine of interest and no binding to any other cytokine are selected.

Example 1.1.2.D

Tissue Cross Reactivity

Tissue cross reactivity studies are done in three stages, with the first stage including cryosections of 32 tissues, second stage including up to 38 tissues, and the 3$^{rd}$ stage including additional tissues from 3 unrelated adults as described below. Studies are done typically at two dose levels.

Stage 1:
Cryosections (about 5 μm) of human tissues (32 tissues (typically: Adrenal Gland, Gastrointestinal Tract, Prostate, Bladder, Heart, Skeletal Muscle, Blood Cells, Kidney, Skin, Bone Marrow, Liver, Spinal Cord, Breast, Lung, Spleen, Cerebellum, Lymph Node, Testes, Cerebral Cortex, Ovary, Thymus, Colon, Pancreas, Thyroid, Endothelium, Parathyroid, Ureter, Eye, Pituitary, Uterus, Fallopian Tube and Placenta) from one human donor obtained at autopsy or biopsy) are fixed and dried on object glass. The peroxidase staining of tissue sections is performed, using the avidin-biotin system.

Stage 2:
Cryosections (about 5 μm) of human tissues 38 tissues (including adrenal, blood, blood vessel, bone marrow, cerebellum, cerebrum, cervix, esophagus, eye, heart, kidney, large intestine, liver, lung, lymph node, breast mammary gland, ovary, oviduct, pancreas, parathyroid, peripheral nerve, pituitary, placenta, prostate, salivary gland, skin, small intestine, spinal cord, spleen, stomach, striated muscle, testis, thymus, thyroid, tonsil, ureter, urinary bladder, and uterus) from 3 unrelated adults obtained at autopsy or biopsy) are fixed and dried on object glass. The peroxidase staining of tissue sections is performed, using the avidin-biotin system.

Stage 3:
Cryosections (about 5 μm) of cynomolgus monkey tissues (38 tissues (including adrenal, blood, blood vessel, bone marrow, cerebellum, cerebrum, cervix, esophagus, eye, heart, kidney, large intestine, liver, lung, lymph node, breast mammary gland, ovary, oviduct, pancreas, parathyroid, peripheral nerve, pituitary, placenta, prostate, salivary gland, skin, small intestine, spinal cord, spleen, stomach, striated muscle, testis, thymus, thyroid, tonsil, ureter, urinary bladder, and uterus) from 3 unrelated adult monkeys obtained at autopsy or biopsy) are fixed and dried on object glass. The peroxidase staining of tissue sections is performed, using the avidin-biotin system.

The antibody or DVD-Ig is incubated with the secondary biotinylated anti-human IgG and developed into immune complex. The immune complex at the final concentrations of 2 and 10 μg/mL of antibody or DVD-Ig is added onto tissue sections on object glass and then the tissue sections are reacted for 30 minutes with a avidin-biotin-peroxidase kit. Subsequently, DAB (3,3'-diaminobenzidine), a substrate for the peroxidase reaction, is applied for 4 minutes for tissue staining. Antigen-Sepharose beads are used as positive control tissue sections. Target antigen and human serum blocking studies serve as additional controls. The immune complex at the final concentrations of 2 and 10 μg/mL of antibody or DVD-Ig is pre-incubated with target antigen (final concentration of 100 μg/ml) or human serum (final concentration 10%) for 30 minutes, and then added onto the tissue sections on object glass and then the tissue sections are reacted for 30 minutes with a avidin-biotin-peroxidase kit. Subsequently, DAB (3,3'-diaminobenzidine), a substrate for the peroxidase reaction, is applied for 4 minutes for tissue staining.

Any specific staining is judged to be either an expected (e.g., consistent with antigen expression) or unexpected reactivity based upon known expression of the target antigen in question. Any staining judged specific is scored for intensity and frequency. The tissue staining between stage 2 (human tissue) and stage 3 (cynomolgus monkey tissue) is either judged to be similar or different.

Example 1.1.2.E

Tumoricidal Effect of A Parent or DVD-Ig Antibody In Vitro

Parent antibodies or DVD-Ig that bind to target antigens on tumor cells may be analyzed for tumoricidal activity. Briefly, parent antibodies or DVD-Ig are diluted in D-PBS-BSA (Dulbecco's phosphate buffered saline with 0.1% BSA) and added to human tumor cells at final concentrations of 0.01 μg/mL to 100 μg/mL in 200 μL. The plates are incubated at 37° C. in a humidified, 5% $CO_2$ atmosphere for 3 days. The number of live cells in each well is quantified using MTS reagents according to the manufacturer's instructions (Promega, Madison, Wis.) to determine the percent of tumor growth inhibition. Wells without antibody treatment are used as controls of 0% inhibition whereas wells without cells are considered to show 100% inhibition.

For assessment of apoptosis, caspase-3 activation is determined by the following protocol: antibody-treated cells in 96 well plates are lysed in 120 μl of 1× lysis buffer (1.67 mM Hepes, pH 7.4, 7 mM KCl, 0.83 mM $MgCl_2$, 0.11 mM EDTA, 0.11 mM EGTA, 0.57% CHAPS, 1 mM DTT, 1× protease inhibitor cocktail tablet; EDTA-free; Roche Pharmaceuticals, Nutley, N.J.) at room temperature with shaking for 20 minutes. After cell lysis, 80 µl of a caspase-3 reaction buffer (48 mM Hepes, pH 7.5, 252 mM sucrose, 0.1% CHAPS, 4 mM DTT, and 20 µM Ac-DEVD-AMC substrate; Biomol Research Labs, Inc., Plymouth Meeting, Pa.) is added and the plates are incubated for 2 hours at 37° C. The plates are read on a 1420 VICTOR Multilabel Counter (Perkin Elmer Life Sciences, Downers Grove, Ill.) using the following settings: excitation=360/40, emission=460/40. An increase of fluorescence units from antibody-treated cells relative to the isotype antibody control-treated cells is seen, which is indicative of apoptosis.

Example 1.1.2.F

Inhibition of Receptor Activation by Antibody or DVD-Ig Constructs In Vitro

Parent antibodies or DVD-Ig that bind to cell receptors or their ligands may be tested for inhibition of receptor activation. Parent antibodies or DVD-Ig diluted in D-PBS-BSA (Dulbecco's phosphate buffered saline with 0.1% BSA) are added to human carcinoma cells at final concentrations of 0.01 µg/mL to 100 µg/mL (180 µL). The plates are incubated at 37° C. in a humidified, 5% $CO_2$ atmosphere for 1 hour. Growth factors (e.g., EGF) at a final concentration of 1-100 ng/mL (20 µL) are added to the cells for 5-15 minutes to stimulate receptor (e.g., EGFR) autophosphorylation. Wells without antibody treatment are used as controls of 0% inhibition whereas wells without growth factor stimulation are considered to show 100% inhibition. Cell lysates are made by incubation with cell extraction buffer (10 mM Tris, pH 7.4, 100 mM NaCl, 1 mM EDTA, 1 mM EGTA, 1 mM NaF, 1 mM sodium orthovanadate, 1% Triton X-100, 10% Glycerol, 0.1% SDS, and protease inhibitor cocktail). For example, phospho-EGFR in these cell lysates is determined using the p-EGFR ELISA kit from R&D Systems (#DYC1095, Minneapolis, Minn.) according to the manufacturer's instructions.

Example 1.1.2.G

Efficacy of an Anti-Tumor Cell Antigen Antibody or DVD-Ig by Itself or in Combination with Chemotherapy on the Growth of Human Carcinoma Xenografts (Subcutaneous Flank, Orthotopic, or Spontaneous Metastases)

Human cancer cells are grown in vitro to 99% viability, 85% confluence in tissue culture flasks. SCID mice (Charles Rivers Labs) at 19-25 grams are ear tagged and shaved. Mice are then inoculated subcutaneously into the right flank with 0.2 ml of $2 \times 10^6$ human tumor cells (1:1 matrigel) on study day 0. Administration (IP, Q3D/week) of vehicle (PBS), antibody or DVD-Ig, and/or chemotherapy is initiated after mice are size matched into separate ages of mice with mean tumor volumes of approximately 150 to 200 $mm^3$. The tumors are measured by a pair of calipers twice a week starting on approximately day 10 post inoculation and the tumor volumes calculated according to the formula V=L×W2/2 (V: volume, mm3; L: length, mm; W: width, mm). Reduction in tumor volume is seen in animals treated with the antibody or DVD-Ig alone or in combination with chemotherapy relative to tumors in animals that received only vehicle or an isotype control mAb.

Example 1.1.2.H

Binding of Monoclonal Antibodies to the Surface of Human Tumor Cell Lines as Assessed by Flow Cytometry Stable cell lines overexpressing a cell-surface antigen of interest or human tumor cell lines are harvested from tissue culture flasks and resuspended in phosphate buffered saline (PBS) containing 5% fetal bovine serum (PBS/FBS). Prior to staining, human tumor cells are incubated on ice with (100 µl) human IgG at 5 µg/ml in PBS/FCS. $1-5 \times 10^5$ cells are incubated with antibody or DVD-Ig (2 µg/mL) in PBS/FBS for 30-60 minutes on ice. Cells are washed twice and 100 µl of F(ab')2 goat anti human IgG, Fcγ-phycoerythrin (1:200 dilution in PBS) (Jackson ImmunoResearch, West Grove, Pa., Cat. #109-116-170) is added. After 30 minutes incubation on ice, cells are washed twice and resuspended in PBS/FBS. Fluorescence is measured using a Becton Dickinson FACSCalibur (Becton Dickinson, San Jose, Calif.).

Example 1.1.2.I

Binding of Monoclonal Antibodies to the Surface of Activated NK Cells as Assessed by Flow Cytometry Activated NK cells were plated at $0.5 \times 10^5$ cells/well on a 96 well round bottom plate. Antibodies and DVD-Igs were diluted to 10 µg/ml in FACS buffer (1% FBS in PBS pH 7.4). The supernatant was removed from the cells and 30 µL of diluted antibodies or DVD-Igs was added to the wells. Cells were incubated with the antibodies at 4° C. for 30 minutes. Following incubation, the cells were washed three times with 150 µL FACS buffer. The cells were resuspended in 50 µL FACS buffer with 1:125 diluted R-PE conjugated anti-human IgG F(Ab')$_2$ (Jackson ImmunoResearch, West Grove, Pa., Cat. #109-116-170), anti-CD56-APC (eBioscience, San Diego, Calif., Cat. #17-0569), or anti-CD3-488 (eBioscience, San Diego, Calif., Cat. #53-0037) and incubated at 4° C. for 30 minutes. Cells were washed three times, and finally resuspended in 100 pt FACS buffer. Samples were run on a FACSCalibur machine (Becton Dickinson, San Jose, Calif.). FACSCalibur settings for FL1, FL2, and FL4 were adjusted such that a non-antibody-treated control sample had a GMFI of 3. Experimental samples were run subsequently. FlowJo software (Treestar, Inc, Ashland, Oreg.) was used to analyze the data and determine R-PE GMFI on CD56 positive, live cells as designated by a forward and side scatter gate.

Example 1.1.2.J

Binding of Monoclonal Antibodies to the Surface of Human Tumor Cell Lines as Assessed by Flow Cytometry Using FACSCanto Stable cell lines overexpressing a cell-surface antigen of interest or human tumor cell lines were harvested from tissue culture flasks and resuspended in phosphate buffered saline (PBS) containing 5% fetal bovine serum (PBS/FBS). Prior to staining, human tumor cells were incubated on ice with (100 µl) human IgG at 5 µg/ml in PBS/FCS. $1-5 \times 10^5$ cells were incubated with antibody or DVD-Ig (2 µg/mL) in PBS/FBS for 30-60 minutes on ice. Cells were washed twice and 100 µl of F(ab')2 goat anti human IgG, Fcγ-Dylight488 (1:200 dilution in PBS) (Jackson ImmunoResearch, West Grove, Pa., Cat. #109-486-098) was added. After 30 minutes incubation on ice, cells were washed twice and resuspended in PBS/FBS. Fluorescence was measured using a Becton Dickinson FACSCanto machine (Becton Dickinson, San Jose, Calif.).

Example 1.1.2.K

IL-1α/β Bioassay and Neutralization Assay

MRC5 cells were plated at 1.5–2×10$^4$ cells per well in a 100 μL volume and incubated overnight at 37° C., 5% CO$_2$. A 20 μg/mL working stock of antibody (4× concentrated) was prepared in complete MEM medium. An eight point serial dilution was performed (5 μg/mL-0.0003 μg/mL) in complete MEM in Marsh dilution plates. Sixty-five μL/well of each antibody dilution was added in quadruplicate to a 96 well v-bottom (Costar#3894) plate and 65 μL of a 200 μg/mL solution of IL-1α or IL-1β or 65 μL of a mixed solution containing a 50 pg/mL solution of both IL-1α and IL-1β was also added. Control wells received 65 μL 200 pg/ml of IL-1α or IL-1β or 50 pg/mL mixed IL-1α/β (4× concentrated) plus 65 μL MEM media and media control wells received 130 μL of media. Following a 1 hour incubation, 100 μL of the Ab/Ag mixture was added to the MRC5 cells. All well volumes were equal to 200 μL. All plate reagents were then 1× concentrated. After a 16-20 hour incubation, the well contents (150 μL) were transferred into a 96-well round bottom plate (Costar#3799) and placed in a −20° C. freezer. The supernatants were tested for hIL-8 levels by using a human IL-8 ELISA kit (R&D Systems, Minneapolis, Minn.) or hIL-8 chemiluminescence kit (MDS). Neutralization potency was determined by calculating percent inhibition relative to the IL-1α, IL-β, or the IL-1α/β alone control value. Results are shown in Table 5.

TABLE 5

IL-1β Neutralization Assay With IL-1β Parent Antibody and DVD-Ig Constructs

| Parent Antibody or DVD-Ig ID | N-Terminal Variable Domain (VD) | C-Terminal Variable Domain (VD) | N-Terminal VD IL-1β Neutralization Assay EC50 nM | C-Terminal VD IL-1β Neutralization Assay EC50 nM |
|---|---|---|---|---|
| AB268 | IL-1B (seq. 1) | | 0.0098 | |
| AB269 | IL-1B (seq. 2) | | 0.0019 | |
| AB270 | IL-1B (seq. 3) | | 0.2448 | |
| AB271 | IL-1B (seq. 4) | | 0.3080 | |
| AB272 | IL-1B (seq. 5) | | 0.2982 | |
| DVD1262 | IL-1B (seq. 1) | IL-17 (seq. 1) | 0.0164 | — |
| DVD1263 | IL-17 (seq. 1) | IL-1B (seq. 1) | — | 19.9650 |
| DVD1264 | IL-1B (seq. 2) | IL-17 (seq. 1) | 0.1205 | — |
| DVD1265 | IL-17 (seq. 1) | IL-1B (seq. 2) | — | 0.9248 |
| DVD1266 | IL-1B (seq. 3) | IL-17 (seq. 1) | 0.3274 | — |
| DVD1267 | IL-17 (seq. 1) | IL-1B (seq. 3) | — | >40 |
| DVD1268 | IL-1B (seq. 4) | IL-17 (seq. 1) | 0.1459 | — |
| DVD1269 | IL-17 (seq. 1) | IL-1B (seq. 4) | — | >45 |
| DVD1270 | IL-1B (seq. 5) | IL-17 (seq. 1) | 0.2652 | — |
| DVD1271 | IL-17 (seq. 1) | IL-1B (seq. 5) | — | >30 |
| DVD1272 | IL-1B (seq. 1) | IL-17 (seq. 2) | 0.0139 | — |
| DVD1273 | IL-17 (seq. 2) | IL-1B (seq. 1) | — | 18.4350 |
| DVD1274 | IL-1B (seq. 2) | IL-17 (seq. 2) | 0.0068 | — |
| DVD1275 | IL-17 (seq. 2) | IL-1B (seq. 2) | — | 1.9160 |
| DVD1276 | IL-1B (seq. 3) | IL-17 (seq. 2) | 0.1683 | — |
| DVD1277 | IL-17 (seq. 2) | IL-1B (seq. 3) | — | >20 |
| DVD1278 | IL-1B (seq. 4) | IL-17 (seq. 2) | 0.1454 | — |
| DVD1279 | IL-17 (seq. 2) | IL-1B (seq. 4) | — | >200 |
| DVD1280 | IL-1B (seq. 5) | IL-17 (seq. 2) | 0.1488 | — |
| DVD1281 | IL-17 (seq. 2) | IL-1B (seq. 5) | — | >150 |
| DVD1282 | IL-1B (seq. 1) | IL-17 (seq. 3) | 0.0091 | — |
| DVD1283 | IL-17 (seq. 3) | IL-1B (seq. 1) | — | 7.6090 |
| DVD1284 | IL-1B (seq. 2) | IL-17 (seq. 3) | 0.0065 | — |
| DVD1285 | IL-17 (seq. 3) | IL-1B (seq. 2) | — | 1.2680 |
| DVD1286 | IL-1B (seq. 3) | IL-17 (seq. 3) | 0.1647 | — |
| DVD1287 | IL-17 (seq. 3) | IL-1B (seq. 3) | — | >50 |
| DVD1288 | IL-1B (seq. 4) | IL-17 (seq. 3) | 0.2124 | — |
| DVD1289 | IL-17 (seq. 3) | IL-1B (seq. 4) | — | 18.8000 |
| DVD1290 | IL-1B (seq. 5) | IL-17 (seq. 3) | 0.2523 | — |
| DVD1291 | IL-17 (seq. 3) | IL-1B (seq. 5) | — | >100 |
| DVD1589 | IL-1B (seq. 1) | IL-17 (seq. 1) | 0.0068 | — |
| DVD1590 | IL-17 (seq. 1) | IL-1B (seq. 1) | — | 1.5970 |
| DVD1591 | IL-1B (seq. 2) | IL-17 (seq. 1) | 0.0023 | — |
| DVD1592 | IL-17 (seq. 1) | IL-1B (seq. 2) | — | 0.1093 |
| DVD1593 | IL-1B (seq. 3) | IL-17 (seq. 1) | 0.1840 | — |
| DVD1594 | IL-17 (seq. 1) | IL-1B (seq. 3) | — | 9.0950 |
| DVD1595 | IL-1B (seq. 4) | IL-17 (seq. 1) | 0.2041 | — |
| DVD1596 | IL-17 (seq. 1) | IL-1B (seq. 4) | — | 3.4390 |
| DVD1597 | IL-1B (seq. 5) | IL-17 (seq. 1) | 0.3259 | — |
| DVD1598 | IL-17 (seq. 1) | IL-1B (seq. 5) | — | 11.9100 |
| DVD1599 | IL-1B (seq. 1) | IL-17 (seq. 2) | 0.0048 | — |
| DVD1600 | IL-17 (seq. 2) | IL-1B (seq. 1) | — | 0.7940 |
| DVD1601 | IL-1B (seq. 2) | IL-17 (seq. 2) | 0.0036 | — |
| DVD1602 | IL-17 (seq. 2) | IL-1B (seq. 2) | — | 0.1330 |
| DVD1603 | IL-1B (seq. 3) | IL-17 (seq. 2) | 0.0803 | — |
| DVD1604 | IL-17 (seq. 2) | IL-1B (seq. 3) | — | 2.0270 |

TABLE 5-continued

IL-1βNeutralization Assay With IL-1β Parent Antibody and DVD-Ig Constructs

| Parent Antibody or DVD-Ig ID | N-Terminal Variable Domain (VD) | C-Terminal Variable Domain (VD) | N-Terminal VD IL-1β Neutralization Assay EC50 nM | C-Terminal VD IL-1β Neutralization Assay EC50 nM |
|---|---|---|---|---|
| DVD1605 | IL-1B (seq. 4) | IL-17 (seq. 2) | 0.2417 | — |
| DVD1606 | IL-17 (seq. 2) | IL-1B (seq. 4) | — | 1.6260 |
| DVD1607 | IL-1B (seq. 5) | IL-17 (seq. 2) | 0.4554 | — |
| DVD1608 | IL-17 (seq. 2) | IL-1B (seq. 5) | — | 4.2460 |
| DVD1609 | IL-1B (seq. 1) | IL-17 (seq. 3) | 0.0038 | — |
| DVD1610 | IL-17 (seq. 3) | IL-1B (seq. 1) | — | 1.0000 |
| DVD1611 | IL-1B (seq. 2) | IL-17 (seq. 3) | 0.0041 | — |
| DVD1612 | IL-17 (seq. 3) | IL-1B (seq. 2) | — | 0.1532 |
| DVD1613 | IL-1B (seq. 3) | IL-17 (seq. 3) | 0.2464 | — |
| DVD1614 | IL-17 (seq. 3) | IL-1B (seq. 3) | — | 0.8015 |
| DVD1615 | IL-1B (seq. 4) | IL-17 (seq. 3) | 0.1907 | — |
| DVD1616 | IL-17 (seq. 3) | IL-1B (seq. 4) | — | 1.1220 |
| DVD1617 | IL-1B (seq. 5) | IL-17 (seq. 3) | 0.2471 | — |
| DVD1618 | IL-17 (seq. 3) | IL-1B (seq. 5) | — | 2.7500 |
| DVD1619 | IL-1B (seq. 1) | IL-17 (seq. 1) | 0.1385 | — |
| DVD1620 | IL-17 (seq. 1) | IL-1B (seq. 1) | — | 17.43 |
| DVD1621 | IL-1B (seq. 2) | IL-17 (seq. 1) | 0.01139 | — |
| DVD1622 | IL-17 (seq. 1) | IL-1B (seq. 2) | — | 3.915 |
| DVD1623 | IL-1B (seq. 3) | IL-17 (seq. 1) | 0.1595 | — |
| DVD1624 | IL-17 (seq. 1) | IL-1B (seq. 3) | — | >20 |
| DVD1625 | IL-1B (seq. 4) | IL-17 (seq. 1) | 0.5217 | — |
| DVD1626 | IL-17 (seq. 1) | IL-1B (seq. 4) | — | 17.44 |
| DVD1627 | IL-1B (seq. 5) | IL-17 (seq. 1) | 0.6208 | — |
| DVD1628 | IL-17 (seq. 1) | IL-1B (seq. 5) | — | 5.85 |
| DVD1629 | IL-1B (seq. 1) | IL-17 (seq. 2) | 0.01264 | — |
| DVD1630 | IL-17 (seq. 2) | IL-1B (seq. 1) | — | 9.383 |
| DVD1631 | IL-1B (seq. 2) | IL-17 (seq. 2) | 0.00417 | — |
| DVD1632 | IL-17 (seq. 2) | IL-1B (seq. 2) | — | 0.438 |
| DVD1633 | IL-1B (seq. 3) | IL-17 (seq. 2) | 0.3712 | — |
| DVD1634 | IL-17 (seq. 2) | IL-1B (seq. 3) | — | >12 |
| DVD1635 | IL-1B (seq. 4) | IL-17 (seq. 2) | 0.2402 | — |
| DVD1636 | IL-17 (seq. 2) | IL-1B (seq. 4) | — | 27.12 |
| DVD1637 | IL-1B (seq. 5) | IL-17 (seq. 2) | 0.5522 | — |
| DVD1638 | IL-17 (seq. 2) | IL-1B (seq. 5) | — | >20 |
| DVD1639 | IL-1B (seq. 1) | IL-17 (seq. 3) | 0.01131 | — |
| DVD1640 | IL-17 (seq. 3) | IL-1B (seq. 1) | — | 2.849 |
| DVD1641 | IL-1B (seq. 2) | IL-17 (seq. 3) | 0.07861 | — |
| DVD1642 | IL-17 (seq. 3) | IL-1B (seq. 2) | — | 0.6281 |
| DVD1643 | IL-1B (seq. 3) | IL-17 (seq. 3) | 0.465 | — |
| DVD1644 | IL-17 (seq. 3) | IL-1B (seq. 3) | — | 1.085 |
| DVD1645 | IL-1B (seq. 4) | IL-17 (seq. 3) | 0.4169 | — |
| DVD1646 | IL-17 (seq. 3) | IL-1B (seq. 4) | — | 20.65 |
| DVD1647 | IL-1B (seq. 5) | IL-17 (seq. 3) | 0.1519 | — |
| DVD1648 | IL-17 (seq. 3) | IL-1B (seq. 5) | — | 16.16 |

All DVD-Igs containing VDs from AB268, AB269, AB270, AB271, or AB272 in either the N-terminal or C-terminal position showed neutralization in the MRC5 IL-1α/β neutralization assay.

Example 1.1.2.L

IL-17 Bioassay and Neutralization Assay

The human HS27 cell line (ATCC #CRL-1634) secretes IL-6 in response to IL-17. The IL-17-induced IL-6 secretion is inhibited by neutralizing anti-IL-17 antibodies (See, e.g., J. Immunol. 155:5483-5486, 1995 or Cytokine 9:794-800, 1997).

HS27 cells were maintained in assay medium (DMEM high glucose medium (Gibco #11965) with 10% fetal bovine serum (Gibco#26140), 4 mM L-glutamine, 1 mM sodium pyruvate, penicillin G (100 U/500 ml) and streptomycin (100 μg/500 ml)). Cells were grown in T150 flasks until they were about 80-90% confluent on the day of the assay. Human IL-17 (R&D Systems, #317-IL/CF) was reconstituted in sterile PBS without $Ca^{2+}$ and $Mg^{2+}$ stored frozen, freshly thawed for use and diluted to 40 ng/ml (4×) in assay medium. Serial dilutions of antibodies were made in a separate plate (4× concentrations), mixed with equal volume of 40 ng/ml (4×) of hu IL-17 and incubated at 37° C. for 1 hour. HS27 cells (typically about 20,000 cells in 50 μl assay medium) were added to each well of a 96-well flat-bottom tissue culture plate (Costar #3599), followed by the addition of 50 μl of the pre-incubated antibody plus IL-17 mixture. The final concentration of IL-17 is 10 ng/ml. Cells were incubated for about 24 hours at 37° C. The media supernatants were then collected. The level of IL-17 neutralization was measured by determining the amount of IL-6 in the supernatant using a commercial Meso Scale Discovery kit according to manufacturers instruction. IC50 values were obtained using logarithm of antibody vs. IL-6 amount variable slope fit (Table 6).

TABLE 6

IL-17 Neutralization Assay With IL-17 Parent Antibody and DVD-Ig Constructs

| Parent Antibody or DVD-Ig ID | N-terminal Variable Domain (VD) | C-terminal Variable Domain (VD) | N-terminal VD IL-17 NeutralizationAssay EC50 nM | C-terminal VD IL-17 NeutralizationAssayEC50 nM |
|---|---|---|---|---|
| AB273 | | IL-17 (seq. 1) | | 0.0161 |
| AB274 | | IL-17 (seq. 2) | | 0.0020 |
| AB275 | | IL-17 (seq. 3) | | 0.0032 |
| DVD1262 | IL-1B (seq. 1) | IL-17 (seq. 1) | — | 0.0162 |
| DVD1263 | IL-17 (seq. 1) | IL-1B (seq. 1) | 0.0052 | — |
| DVD1264 | IL-1B (seq. 2) | IL-17 (seq. 1) | — | 0.0084 |
| DVD1265 | IL-17 (seq. 1) | IL-1B (seq. 2) | 0.0028 | — |
| DVD1266 | IL-1B (seq. 3) | IL-17 (seq. 1) | — | 0.0150 |
| DVD1267 | IL-17 (seq. 1) | IL-1B (seq. 3) | 0.0109 | — |
| DVD1268 | IL-1B (seq. 4) | IL-17 (seq. 1) | — | 0.0034 |
| DVD1269 | IL-17 (seq. 1) | IL-1B (seq. 4) | 0.0082 | — |
| DVD1270 | IL-1B (seq. 5) | IL-17 (seq. 1) | — | 0.0407 |
| DVD1271 | IL-17 (seq. 1) | IL-1B (seq. 5) | 0.0109 | — |
| DVD1272 | IL-1B (seq. 1) | IL-17 (seq. 2) | — | 0.3463 |
| DVD1273 | IL-17 (seq. 2) | IL-1B (seq. 1) | 0.0013 | — |
| DVD1274 | IL-1B (seq. 2) | IL-17 (seq. 2) | — | 1.081 |
| DVD1275 | IL-17 (seq. 2) | IL-1B (seq. 2) | 0.0006 | — |
| DVD1276 | IL-1B (seq. 3) | IL-17 (seq. 2) | — | 1.207 |
| DVD1277 | IL-17 (seq. 2) | IL-1B (seq. 3) | 0.0092 | — |
| DVD1278 | IL-1B (seq. 4) | IL-17 (seq. 2) | — | 0.3456 |
| DVD1279 | IL-17 (seq. 2) | IL-1B (seq. 4) | 0.0052 | — |
| DVD1280 | IL-1B (seq. 5) | IL-17 (seq. 2) | — | 0.2564 |
| DVD1281 | IL-17 (seq. 2) | IL-1B (seq. 5) | 0.0027 | — |
| DVD1282 | IL-1B (seq. 1) | IL-17 (seq. 3) | — | >20 |
| DVD1283 | IL-17 (seq. 3) | IL-1B (seq. 1) | 0.0238 | — |
| DVD1284 | IL-1B (seq. 2) | IL-17 (seq. 3) | — | >20 |
| DVD1285 | IL-17 (seq. 3) | IL-1B (seq. 2) | 0.0021 | — |
| DVD1286 | IL-1B (seq. 3) | IL-17 (seq. 3) | — | 0.2587 |
| DVD1287 | IL-17 (seq. 3) | IL-1B (seq. 3) | 0.0035 | — |
| DVD1288 | IL-1B (seq. 4) | IL-17 (seq. 3) | — | 0.1113 |
| DVD1289 | IL-17 (seq. 3) | IL-1B (seq. 4) | 0.0960 | — |
| DVD1290 | IL-1B (seq. 5) | IL-17 (seq. 3) | — | 0.0181 |
| DVD1291 | IL-17 (seq. 3) | IL-1B (seq. 5) | 0.0062 | — |
| DVD1589 | IL-1B (seq. 1) | IL-17 (seq. 1) | — | 0.0011 |
| DVD1590 | IL-17 (seq. 1) | IL-1B (seq. 1) | 0.0016 | — |
| DVD1591 | IL-1B (seq. 2) | IL-17 (seq. 1) | — | 0.0393 |
| DVD1592 | IL-17 (seq. 1) | IL-1B (seq. 2) | 0.0117 | — |
| DVD1593 | IL-1B (seq. 3) | IL-17 (seq. 1) | — | 0.0010 |
| DVD1594 | IL-17 (seq. 1) | IL-1B (seq. 3) | 0.0025 | — |
| DVD1595 | IL-1B (seq. 4) | IL-17 (seq. 1) | — | 0.0019 |
| DVD1596 | IL-17 (seq. 1) | IL-1B (seq. 4) | 0.0007 | — |
| DVD1597 | IL-1B (seq. 5) | IL-17 (seq. 1) | — | 0.0008 |
| DVD1598 | IL-17 (seq. 1) | IL-1B (seq. 5) | 0.0053 | — |
| DVD1599 | IL-1B (seq. 1) | IL-17 (seq. 2) | — | 0.0504 |
| DVD1600 | IL-17 (seq. 2) | IL-1B (seq. 1) | 0.0055 | — |
| DVD1601 | IL-1B (seq. 2) | IL-17 (seq. 2) | — | 0.0264 |
| DVD1602 | IL-17 (seq. 2) | IL-1B (seq. 2) | 0.0033 | — |
| DVD1603 | IL-1B (seq. 3) | IL-17 (seq. 2) | — | 0.0407 |
| DVD1604 | IL-17 (seq. 2) | IL-1B (seq. 3) | 0.0031 | — |
| DVD1605 | IL-1B (seq. 4) | IL-17 (seq. 2) | — | 0.0082 |
| DVD1606 | IL-17 (seq. 2) | IL-1B (seq. 4) | 0.0188 | — |
| DVD1607 | IL-1B (seq. 5) | IL-17 (seq. 2) | — | 0.0031 |
| DVD1608 | IL-17 (seq. 2) | IL-1B (seq. 5) | 0.0082 | — |
| DVD1609 | IL-1B (seq. 1) | IL-17 (seq. 3) | — | 0.1728 |
| DVD1610 | IL-17 (seq. 3) | IL-1B (seq. 1) | 0.0046 | — |
| DVD1611 | IL-1B (seq. 2) | IL-17 (seq. 3) | — | 0.3001 |
| DVD1612 | IL-17 (seq. 3) | IL-1B (seq. 2) | 0.0238 | — |
| DVD1613 | IL-1B (seq. 3) | IL-17 (seq. 3) | — | 0.1013 |
| DVD1614 | IL-17 (seq. 3) | IL-1B (seq. 3) | 0.0142 | — |
| DVD1615 | IL-1B (seq. 4) | IL-17 (seq. 3) | — | 0.0610 |
| DVD1616 | IL-17 (seq. 3) | IL-1B (seq. 4) | 0.0062 | — |
| DVD1617 | IL-1B (seq. 5) | IL-17 (seq. 3) | — | 0.0424 |
| DVD1618 | IL-17 (seq. 3) | IL-1B (seq. 5) | 0.0045 | — |
| DVD1619 | IL-1B (seq. 1) | IL-17 (seq. 1) | — | 0.0345 |
| DVD1620 | IL-17 (seq. 1) | IL-1B (seq. 1) | 0.0067 | — |
| DVD1621 | IL-1B (seq. 2) | IL-17 (seq. 1) | — | 0.0397 |
| DVD1622 | IL-17 (seq. 1) | IL-1B (seq. 2) | 0.0083 | — |
| DVD1623 | IL-1B (seq. 3) | IL-17 (seq. 1) | — | 0.0238 |
| DVD1624 | IL-17 (seq. 1) | IL-1B (seq. 3) | 0.0042 | — |
| DVD1625 | IL-1B (seq. 4) | IL-17 (seq. 1) | — | 0.0076 |
| DVD1626 | IL-17 (seq. 1) | IL-1B (seq. 4) | 0.0064 | — |
| DVD1627 | IL-1B (seq. 5) | IL-17 (seq. 1) | — | 0.0586 |

TABLE 6-continued

IL-17 Neutralization Assay With IL-17 Parent Antibody and DVD-Ig Constructs

| Parent Antibody or DVD-Ig ID | N-terminal Variable Domain (VD) | C-terminal Variable Domain (VD) | N-terminal VD IL-17 NeutralizationAssay EC50 nM | C-terminal VD IL-17 NeutralizationAssayEC50 nM |
|---|---|---|---|---|
| DVD1628 | IL-17 (seq. 1) | IL-1B (seq. 5) | 0.0163 | — |
| DVD1629 | IL-1B (seq. 1) | IL-17 (seq. 2) | — | 0.3595 |
| DVD1630 | IL-17 (seq. 2) | IL-1B (seq. 1) | 0.0041 | — |
| DVD1631 | IL-1B (seq. 2) | IL-17 (seq. 2) | — | 0.4604 |
| DVD1632 | IL-17 (seq. 2) | IL-1B (seq. 2) | 0.0065 | — |
| DVD1633 | IL-1B (seq. 3) | IL-17 (seq. 2) | — | 0.1463 |
| DVD1634 | IL-17 (seq. 2) | IL-1B (seq. 3) | 0.0241 | — |
| DVD1635 | IL-1B (seq. 4) | IL-17 (seq. 2) | — | 0.1273 |
| DVD1636 | IL-17 (seq. 2) | IL-1B (seq. 4) | 0.0075 | — |
| DVD1637 | IL-1B (seq. 5) | IL-17 (seq. 2) | — | 0.0271 |
| DVD1638 | IL-17 (seq. 2) | IL-1B (seq. 5) | 0.0069 | — |
| DVD1639 | IL-1B (seq. 1) | IL-17 (seq. 3) | — | 2.613 |
| DVD1640 | IL-17 (seq. 3) | IL-1B (seq. 1) | 0.0061 | — |
| DVD1641 | IL-1B (seq. 2) | IL-17 (seq. 3) | — | 1.874 |
| DVD1642 | IL-17 (seq. 3) | IL-1B (seq. 2) | 0.0043 | — |
| DVD1643 | IL-1B (seq. 3) | IL-17 (seq. 3) | — | 0.1206 |
| DVD1644 | IL-17 (seq. 3) | IL-1B (seq. 3) | 0.0122 | — |
| DVD1645 | IL-1B (seq. 4) | IL-17 (seq. 3) | — | 0.1497 |
| DVD1646 | IL-17 (seq. 3) | IL-1B (seq. 4) | 0.0082 | — |
| DVD1647 | IL-1B (seq. 5) | IL-17 (seq. 3) | — | 0.3398 |
| DVD1648 | IL-17 (seq. 3) | IL-1B (seq. 5) | 0.0089 | — |

All DVD-Igs containing VDs from AB273, AB274, or AB275 in either the N-terminal or C-terminal position showed neutralization in the IL-17 neutralization assay.

Example 1.2

Generation of Parent Monoclonal Antibodies to a Human Antigen of Interest

Parent mouse mAbs able to bind to and neutralize a human antigen of interest and a variant thereof are obtained as follows:

Example 1.2.A

Immunization of Mice with a Human Antigen of Interest

Twenty micrograms of recombinant purified human antigen (e.g., IGF1,2) mixed with complete Freund's adjuvant or Immunoeasy adjuvant (Qiagen, Valencia, Calif.) is injected subcutaneously into five 6-8 week-old Balb/C, five C57B/6 mice, and five AJ mice on Day 1. On days 24, 38, and 49, twenty micrograms of recombinant purified human antigen variant mixed with incomplete Freund's adjuvant or Immunoeasy adjuvant is injected subcutaneously into the same mice. On day 84 or day 112 or day 144, mice are injected intravenously with 1 µg recombinant purified human antigen of interest.

Example 1.2.B

Generation of a Hybridoma

Splenocytes obtained from the immunized mice described in Example 1.2.A are fused with SP2/O-Ag-14 cells at a ratio of 5:1 according to the established method described in Kohler, G. and Milstein (1975) Nature, 256:495 to generate hybridomas. Fusion products are plated in selection media containing azaserine and hypoxanthine in 96-well plates at a density of $2.5 \times 10^6$ spleen cells per well. Seven to ten days post fusion, macroscopic hybridoma colonies are observed. Supernatant from each well containing hybridoma colonies is tested by ELISA for the presence of antibody to the antigen of interest (as described in Example 1.1.1). Supernatants displaying antigen-specific activity are then tested for activity (as described in the assays of Example 1.1.2), for example, the ability to neutralize the antigen of interest in a bioassay such as that described in Example 1.1.2.).

Example 1.2.C

Identification and Characterization of Parent Monoclonal Antibodies to a Human Target Antigen of Interest Example 1.2.C.1

Analyzing Parent Monoclonal Antibody Neutralizing Activity

Hybridoma supernatants are assayed for the presence of parent antibodies that bind an antigen of interest, generated according to Examples 1.2.A and 1.2.B, and a variant of the antigen of interest ("antigen variant"). Supernatants with antibodies positive in both assays are then tested for their antigen neutralization potency, for example, in the cytokine bioassay of Example 1.1.2. The hybridomas producing antibodies with $IC_{50}$ values in the bioassay less than 1,000 µM, in an embodiment, less than 100 pM are scaled up and cloned by limiting dilution. Hybridoma cells are expanded into media containing 10% low IgG fetal bovine serum (Hyclone #SH30151, Logan, Utah). On average, 250 mL of each hybridoma supernatant (derived from a clonal population) is harvested, concentrated and purified by protein A affinity chromatography, as described in Harlow, E. and Lane, D. 1988 "Antibodies: A Laboratory Manual". The ability of purified mAbs to inhibit the activity of its target antigen is determined, for example, using the cytokine bioassay as described in Example 1.1.2.

Example 1.2.C.2

Analyzing Parent Monoclonal Antibody Cross-Reactivity to Cynomolgus Target Antigen of Interest To determine whether the selected mAbs described herein recognize cynomolgus antigen of interest, BIACORE analysis is conducted as described herein (Example 1.1.1.B) using recombinant cynomolgus target antigen. In addition, neutralization potencies of mAbs against recombinant cynomolgus antigen of interest may also be measured in the cytokine bioassay (Example 1.1.2.A). MAbs with good cyno cross-reactivity (in an embodiment, within 5-fold of reactivity for human antigen) are selected for future characterization.

Example 1.2.D

Determination of the Amino Acid Sequence of the Variable Region for Each Murine Anti-Human Monoclonal Antibody Isolation of the cDNAs, expression and characterization of the recombinant anti-human mouse mAbs is conducted as follows. For each amino acid sequence determination, approximately $1 \times 10^6$ hybridoma cells are isolated by centrifugation and processed to isolate total RNA with Trizol (Gibco BRL/Invitrogen, Carlsbad, Calif.) following manufacturer's instructions. Total RNA is subjected to first strand DNA synthesis using the SuperScript First-Strand Synthesis System (Invitrogen, Carlsbad, Calif.) per the manufacturer's instructions. Oligo(dT) is used to prime first-strand synthesis to select for poly(A)+ RNA. The first-strand cDNA product is then amplified by PCR with primers designed for amplification of murine immunoglobulin variable regions (Ig-Primer Sets, Novagen, Madison, Wis.). PCR products are resolved on an agarose gel, excised, purified, and then subcloned with the TOPO Cloning kit into pCR2.1-TOPO vector (Invitrogen, Carlsbad, Calif.) and transformed into TOP10 chemically competent *E. coli* (Invitrogen, Carlsbad, Calif.). Colony PCR is performed on the transformants to identify clones containing insert. Plasmid DNA is isolated from clones containing insert using a QIAprep Miniprep kit (Qiagen, Valencia, Calif.). Inserts in the plasmids are sequenced on both strands to determine the variable heavy or variable light chain DNA sequences using M13 forward and M13 reverse primers (Fermentas Life Sciences, Hanover Md.). Variable heavy and variable light chain sequences of the mAbs are identified. In an embodiment, the selection criteria for a panel of lead mAbs for next step development (humanization) includes the following:

- The antibody does not contain any N-linked glycosylation sites (NXS), except from the standard one in CH2
- The antibody does not contain any extra cysteines in addition to the normal cysteines in every antibody
- The antibody sequence is aligned with the closest human germline sequences for VH and VL and any unusual amino acids should be checked for occurrence in other natural human antibodies
- N-terminal Glutamine (Q) is changed to Glutamic acid (E) if it does not affect the activity of the antibody. This will reduce heterogeneity due to cyclization of Q
- Efficient signal sequence cleavage is confirmed by Mass Spectrophotometry. This can be done with COS cell or 293 cell material
- The protein sequence is checked for the risk of deamidation of Asn that could result in loss of activity
- The antibody has a low level of aggregation
- The antibody has solubility >5-10 mg/ml (in research phase); >25 mg/ml
- The antibody has a normal size (5-6 nm) by Dynamic Light Scattering (DLS)
- The antibody has a low charge heterogeneity
- The antibody lacks cytokine release (see Example 1.1.2.B)
- The antibody has specificity for the intended cytokine (see Example 1.1.2.C)
- The antibody lacks unexpected tissue cross reactivity (see Example 1.1.2.D)
- The antibody has similarity between human and cynomolgus tissue cross reactivity (see Example 1.1.2.D)

Example 1.2.2

Recombinant Humanized Parent Antibodies

Example 1.2.2.1

Construction and Expression of Recombinant Chimeric Anti Human Parent Antibodies The DNA encoding the heavy chain constant region of murine anti-human parent mAbs is replaced by a cDNA fragment encoding the human IgG1 constant region containing 2 hinge-region amino acid mutations by homologous recombination in bacteria. These mutations are a leucine to alanine change at position 234 (EU numbering) and a leucine to alanine change at position 235 (Lund et al. (1991) J. Immunol.: 147:2657). The light chain constant region of each of these antibodies is replaced by a human kappa constant region. Full-length chimeric antibodies are transiently expressed in COS cells by co-transfection of chimeric heavy and light chain cDNAs ligated into the pBOS expression plasmid (Mizushima and Nagata (1990) Nucl. Acids Res. 18: 5322). Cell supernatants containing recombinant chimeric antibody are purified by Protein A Sepharose chromatography and bound antibody is eluted by addition of acid buffer. Antibodies are neutralized and dialyzed into PBS.

The heavy chain cDNA encoding a chimeric mAb is co-transfected with its chimeric light chain cDNA (both ligated in the pBOS vector) into COS cells. Cell supernatant containing recombinant chimeric antibody is purified by Protein A Sepharose chromatography and bound antibody is eluted by addition of acid buffer. Antibodies are neutralized and dialyzed into PBS.

The purified chimeric anti-human parent mAbs are then tested for their ability to bind (by Biacore) and for functional activity, e.g., to inhibit the cytokine induced production of IgE as described in Examples 1.1.1 and 1.1.2. Chimeric mAbs that maintain the activity of the parent hybridoma mAbs are selected for future development.

Example 1.2.2.2

Construction and Expression of Humanized Anti Human Parent Antibodies

Example 1.2.2.2.A

Selection of Human Antibody Frameworks

Each murine variable heavy and variable light chain gene sequence is separately aligned against 44 human immunoglobulin germline variable heavy chain or 46 germline variable light chain sequences (derived from NCBI Ig Blast website) using Vector NTI software.

Humanization was based on amino acid sequence homology, CDR cluster analysis, frequency of use among expressed human antibodies, and available information on the crystal structures of human antibodies. Taking into account possible effects on antibody binding, VH-VL pairing, and other factors, murine residues were mutated to human residues where murine and human framework residues were different, with a few exceptions. Additional humanization strategies were designed based on an analysis of human germline antibody sequences, or a subgroup thereof, that possessed a high degree of homology, i.e., sequence similarity, to the actual amino acid sequence of the murine antibody variable regions.

Homology modeling was used to identify residues unique to the murine antibody sequences that were predicted to be critical to the structure of the antibody combining site, the CDRs. Homology modeling is a computational method whereby approximate three dimensional coordinates are generated for a protein. The source of initial coordinates and guidance for their further refinement is a second protein, the reference protein, for which the three dimensional coordinates are known and the sequence of which is related to the sequence of the first protein. The relationship among the sequences of the two proteins is used to generate a correspondence between the reference protein and the protein for which coordinates are desired, the target protein. The primary sequences of the reference and target proteins are aligned with coordinates of identical portions of the two proteins transferred directly from the reference protein to the target protein. Coordinates for mismatched portions of the two proteins, e.g., from residue mutations, insertions, or deletions, are constructed from generic structural templates and energy refined to insure consistency with the already transferred model coordinates. This computational protein structure may be further refined or employed directly in modeling studies. The quality of the model structure is determined by the accuracy of the contention that the reference and target proteins are related and the precision with which the sequence alignment is constructed.

For the murine mAbs, a combination of BLAST searching and visual inspection was used to identify suitable reference structures. Sequence identity of 25% between the reference and target amino acid sequences was considered the minimum necessary to attempt a homology modeling exercise. Sequence alignments were constructed manually and model coordinates were generated with the program Jackal (see Petrey, D. et al. (2003) Proteins 53 (Suppl. 6): 430-435).

The primary sequences of the murine and human framework regions of the selected antibodies shared significant identity. Residue positions that differ were candidates for inclusion of the murine residue in the humanized sequence in order to retain the observed binding potency of the murine antibody. A list of framework residues that differ between the human and murine sequences was constructed manually. Table 7 shows the framework sequences chosen for this study.

TABLE 7

Sequence Of Human IgG Heavy Chain Constant Domain And Light Chain Constant Domain

| Protein | SEQ ID NO | Sequence 1234567890123456789012345678901234 5678901 |
|---|---|---|
| Wild type hIgG1 constant region | 46 | ASTKGPSVFPLAPSSKSTSGGTAALGCLVKDYFP EPVTVSWNSGALTSGVHTFPAVLQSSGLYSLSSV VTVPSSSLGTQTYICNVNHKPSNTKVDKKVEPKS CDKTHTCPPCPAPE LL GGPSVFLFPPKPKDTLMI SRTPEVTCVVVDVSHEDPEVKFNWYVDGVEVHNA KTKPREEQYNSTYRVVSVLTVLHQDWLNGKEYKC KVSNKALPAPIEKTISKAKGQPREPQVYTLPPSR EEMTKNQVSLTCLVKGFYPSDIAVEWESNGQPEN NYKTTPPVLDSDGSFFLYSKLTVDKSRWQQGNVF SCSVMHEALHNHYTQKSLSLSPGK |
| Mutant hIgG1 constant region | 47 | ASTKGPSVFPLAPSSKSTSGGTAALGCLVKDYFP EPVTVSWNSGALTSGVHTFPAVLQSSGLYSLSSV VTVPSSSLGTQTYICNVNHKPSNTKVDKKVEPKS CDKTHTCPPCPAPEAAGGPSVFLFPPKPKDTLMI SRTPEVTCVVVDVSHEDPEVKFNWYVDGVEVHNA KTKPREEQYNSTYRVVSVLTVLHQDWLNGKEYKC KVSNKALPAPIEKTISKAKGQPREPQVYTLPPSR EEMTKNQVSLTCLVKGFYPSDIAVEWESNGQPEN NYKTTPPVLDSDGSFFLYSKLTVDKSRWQQGNVF SCSVMHEALHNHYTQKSLSLSPGK |
| Ig kappa constant region | 48 | TVAAPSVFIFPPSDEQLKSGTASVVCLLNNFYPR EAKVQWKVDNALQSGNSQESVTEQDSKDSTYSLS STLTLSKADYEKHKVYACEVTHQGLSSPVTKSFN RGEC |
| Ig Lambda constant region | 49 | QPKAAPSVTLFPPSSEELQANKATLVCLISDFYP GAVTVAWKADSSPVKAGVETTTPSKQSNNKYAAS SYLSLTPEQWKSHRSYSCQVTHEGSTVEKTVAPT ECS |

The likelihood that a given framework residue would impact the binding properties of the antibody depends on its proximity to the CDR residues. Therefore, using the model structures, the residues that differ between the murine and human sequences are ranked according to their distance from any atom in the CDRs. Those residues that fell within 4.5 Å of any CDR atom are identified as most important and are recommended to be candidates for retention of the murine residue in the humanized antibody (i.e., back mutation).

In silico constructed humanized antibodies are constructed using oligonucleotides. For each variable region cDNA, 6 oligonucleotides of 60-80 nucleotides each are designed to overlap each other by 20 nucleotides at the 5' and/or 3' end of each oligonucleotide. In an annealing reaction, all 6 oligonulceotides are combined, boiled, and annealed in the presence of dNTPs. DNA polymerase I, Large (Klenow) fragment (New England Biolabs #M0210, Beverley, Mass.) is added to fill-in the approximately 40 bp gaps between the overlapping oligonucleotides. PCR is performed to amplify the entire variable region gene using two outermost primers containing overhanging sequences complementary to the multiple cloning site in a modified pBOS vector (Mizushima, S. and Nagata, S. (1990) Nucleic Acids Res. 18: 17). The PCR products derived from each cDNA assembly are separated on an agarose gel and the band corresponding to the predicted variable region cDNA size is excised and purified. The variable heavy region is inserted in-frame onto a cDNA fragment encoding the human IgG1 constant region containing 2 hinge-region amino acid mutations by homologous recombination in bacteria. These mutations are a leucine to alanine change at position 234 (EU numbering) and a leucine to alanine change at position 235 (Lund et al. (1991) J. Immunol. 147:2657). The variable light chain region is inserted in-frame with the human kappa constant region by homologous recombination. Bacterial colonies are isolated and plasmid DNA extracted. cDNA inserts are sequenced in their entirety. Correct humanized heavy and light chains corresponding to each antibody are co-transfected into COS cells to transiently produce full-length humanized anti-human antibodies. Cell supernatants containing recombinant chimeric antibody are purified by Protein A Sepharose chromatography and bound antibody is eluted by addition of acid buffer. Antibodies are neutralized and dialyzed into PBS.

Example 1.2.2.3

Characterization of Humanized Antibodies

The ability of purified humanized antibodies to inhibit a functional activity is determined, e.g., using the cytokine bioassay as described in Examples 1.1.2.A. The binding affinities of the humanized antibodies to recombinant human antigen are determined using surface plasmon resonance (Biacore®) measurement as described in Example 1.1.1.B. The $IC_{50}$ values from the bioassays and the affinity of the humanized antibodies are ranked. The humanized mAbs that fully maintain the activity of the parent hybridoma mAbs are selected as candidates for future development. The top 2-3 most favorable humanized mAbs are further characterized.

Example 1.2.2.3.A

Pharmacokinetic Analysis of Humanized Antibodies

Pharmacokinetic studies are carried out in Sprague-Dawley rats and cynomolgus monkeys. Male and female rats and cynomolgus monkeys are dosed intravenously or subcutaneously with a single dose of 4 mg/kg mAb and samples are analyzed using antigen capture ELISA, and pharmacokinetic parameters are determined by noncompartmental analysis. Briefly, ELISA plates are coated with goat anti-biotin antibody (5 mg/ml, 4° C., overnight), blocked with Superblock (Pierce), and incubated with biotinylated human antigen at 50 ng/ml in 10% Superblock TTBS at room temperature for 2 hours. Serum samples are serially diluted (0.5% serum, 10% Superblock in TTBS) and incubated on the plate for 30 minutes at room temperature. Detection is carried out with HRP-labeled goat anti human antibody and concentrations are determined with the help of standard curves using the four parameter logistic fit. Values for the pharmacokinetic parameters are determined by non-compartmental model using WinNonlin software (Pharsight Corporation, Mountain View, Calif.). Humanized mAbs with good pharmacokinetics profile (T½ is 8-13 days or better, with low clearance and excellent bioavailability 50-100%) are selected.

Example 1.2.2.3.B

Physicochemical and In Vitro Stability Analysis of Humanized Monoclonal Antibodies Size Exclusion Chromatography Antibodies were diluted to 2.5 mg/mL with water and 20 mL was analyzed on a Shimadzu HPLC system using a TSK gel G3000 SWXL column (Tosoh Bioscience, cat#k5539-05k). Samples were eluted from the column with 211 mM sodium sulfate, 92 mM sodium phosphate, pH 7.0, at a flow rate of 0.3 mL/minutes. The HPLC system operating conditions were the following:

Mobile phase: 211 mM $Na_2SO_4$, 92 mM $Na_2HPO_4*7H_2O$, pH 7.0
Gradient: Isocratic
Flow rate: 0.3 mL/minute
Detector wavelength: 280 nm
Autosampler cooler temp: 4° C.
Column oven temperature: Ambient
Run time: 50 minutes

TABLE 8

Purity of Parent Antibodies and DVD-Ig Constructs as Determined by Size Exclusion Chromatography (SEC)

| Parent Antibody or DVD-Ig ID | N-Terminal Variable Domain (VD) | C-Terminal Variable Domain (VD) | % Monomer (purity) |
|---|---|---|---|
| AB268 | | IL-1B (seq. 1) | 99 |
| AB269 | | IL-1B (seq. 2) | 99 |
| AB270 | | IL-1B (seq. 3) | 90.6 |
| AB271 | | IL-1B (seq. 4) | 95.5 |
| AB272 | | IL-1B (seq. 5) | 93.1 |
| AB273 | | IL-17 (seq. 1) | 100 |
| AB274 | | IL-17 (seq. 2) | 70.7 |
| AB275 | | IL-17 (seq. 3) | 94.5 |
| DVD1262 | IL-1B (seq. 1) | IL-17 (seq. 1) | 98.7 |
| DVD1263 | IL-17 (seq. 1) | IL-1B (seq. 1) | 100 |
| DVD1264 | IL-1B (seq. 2) | IL-17 (seq. 1) | 99 |
| DVD1265 | IL-17 (seq. 1) | IL-1B (seq. 2) | 98.9 |
| DVD1266 | IL-1B (seq. 3) | IL-17 (seq. 1) | 85.7 |
| DVD1267 | IL-17 (seq. 1) | IL-1B (seq. 3) | 100 |
| DVD1268 | IL-1B (seq. 4) | IL-17 (seq. 1) | 88.2 |
| DVD1269 | IL-17 (seq. 1) | IL-1B (seq. 4) | 98 |
| DVD1270 | IL-1B (seq. 5) | IL-17 (seq. 1) | 93.3 |
| DVD1271 | IL-17 (seq. 1) | IL-1B (seq. 5) | 99.2 |
| DVD1272 | IL-1B (seq. 1) | IL-17 (seq. 2) | 98.9 |
| DVD1273 | IL-17 (seq. 2) | IL-1B (seq. 1) | 62.1 |
| DVD1274 | IL-1B (seq. 2) | IL-17 (seq. 2) | 99.7 |
| DVD1275 | IL-17 (seq. 2) | IL-1B (seq. 2) | 63.6 |
| DVD1276 | IL-1B (seq. 3) | IL-17 (seq. 2) | 91 |
| DVD1277 | IL-17 (seq. 2) | IL-1B (seq. 3) | 77.2 |
| DVD1278 | IL-1B (seq. 4) | IL-17 (seq. 2) | 95.9 |
| DVD1279 | IL-17 (seq. 2) | IL-1B (seq. 4) | 62.9 |
| DVD1280 | IL-1B (seq. 5) | IL-17 (seq. 2) | 92 |
| DVD1281 | IL-17 (seq. 2) | IL-1B (seq. 5) | 66.5 |
| DVD1282 | IL-1B (seq. 1) | IL-17 (seq. 3) | 97.1 |
| DVD1283 | IL-17 (seq. 3) | IL-1B (seq. 1) | 100 |
| DVD1284 | IL-1B (seq. 2) | IL-17 (seq. 3) | 98.7 |
| DVD1285 | IL-17 (seq. 3) | IL-1B (seq. 2) | 92.4 |
| DVD1286 | IL-1B (seq. 3) | IL-17 (seq. 3) | 100 |
| DVD1287 | IL-17 (seq. 3) | IL-1B (seq. 3) | 100 |
| DVD1288 | IL-1B (seq. 4) | IL-17 (seq. 3) | 94.9 |
| DVD1289 | IL-17 (seq. 3) | IL-1B (seq. 4) | 95.9 |
| DVD1290 | IL-1B (seq. 5) | IL-17 (seq. 3) | 100 |
| DVD1291 | IL-17 (seq. 3) | IL-1B (seq. 5) | 100 |
| DVD1589 | IL-1B (seq. 1) | IL-17 (seq. 1) | 98.4 |
| DVD1590 | IL-17 (seq. 1) | IL-1B (seq. 1) | 98.9 |
| DVD1591 | IL-1B (seq. 2) | IL-17 (seq. 1) | 100 |
| DVD1592 | IL-17 (seq. 1) | IL-1B (seq. 2) | 100 |
| DVD1593 | IL-1B (seq. 3) | IL-17 (seq. 1) | 95.4 |
| DVD1594 | IL-17 (seq. 1) | IL-1B (seq. 3) | 98.5 |
| DVD1595 | IL-1B (seq. 4) | IL-17 (seq. 1) | 93 |
| DVD1596 | IL-17 (seq. 1) | IL-1B (seq. 4) | 97.7 |
| DVD1597 | IL-1B (seq. 5) | IL-17 (seq. 1) | 95.7 |
| DVD1598 | IL-17 (seq. 1) | IL-1B (seq. 5) | 100 |
| DVD1599 | IL-1B (seq. 1) | IL-17 (seq. 2) | 99.1 |
| DVD1600 | IL-17 (seq. 2) | IL-1B (seq. 1) | 60.7 |
| DVD1601 | IL-1B (seq. 2) | IL-17 (seq. 2) | 99.3 |
| DVD1602 | IL-17 (seq. 2) | IL-1B (seq. 2) | 58 |
| DVD1603 | IL-1B (seq. 3) | IL-17 (seq. 2) | 93.7 |
| DVD1604 | IL-17 (seq. 2) | IL-1B (seq. 3) | 64.8 |
| DVD1605 | IL-1B (seq. 4) | IL-17 (seq. 2) | 97.8 |

TABLE 8-continued

Purity of Parent Antibodies and DVD-Ig Constructs as Determined by Size Exclusion Chromatography (SEC)

| Parent Antibody or DVD-Ig ID | N-Terminal Variable Domain (VD) | C-Terminal Variable Domain (VD) | % Monomer (purity) |
|---|---|---|---|
| DVD1606 | IL-17 (seq. 2) | IL-1B (seq. 4) | 62.2 |
| DVD1607 | IL-1B (seq. 5) | IL-17 (seq. 2) | 95.9 |
| DVD1608 | IL-17 (seq. 2) | IL-1B (seq. 5) | 64.5 |
| DVD1609 | IL-1B (seq. 1) | IL-17 (seq. 3) | 95.5 |
| DVD1610 | IL-17 (seq. 3) | IL-1B (seq. 1) | 98.6 |
| DVD1611 | IL-1B (seq. 2) | IL-17 (seq. 3) | 98 |
| DVD1612 | IL-17 (seq. 3) | IL-1B (seq. 2) | 98.1 |
| DVD1613 | IL-1B (seq. 3) | IL-17 (seq. 3) | 85.5 |
| DVD1614 | IL-17 (seq. 3) | IL-1B (seq. 3) | 98.1 |
| DVD1615 | IL-1B (seq. 4) | IL-17 (seq. 3) | 93.3 |
| DVD1616 | IL-17 (seq. 3) | IL-1B (seq. 4) | 97.9 |
| DVD1617 | IL-1B (seq. 5) | IL-17 (seq. 3) | 89.5 |
| DVD1618 | IL-17 (seq. 3) | IL-1B (seq. 5) | 100 |
| DVD1619 | IL-1B (seq. 1) | IL-17 (seq. 1) | 98.6 |
| DVD1620 | IL-17 (seq. 1) | IL-1B (seq. 1) | 100 |
| DVD1621 | IL-1B (seq. 2) | IL-17 (seq. 1) | 99.3 |
| DVD1622 | IL-17 (seq. 1) | IL-1B (seq. 2) | 100 |
| DVD1623 | IL-1B (seq. 3) | IL-17 (seq. 1) | 90.8 |
| DVD1624 | IL-17 (seq. 1) | IL-1B (seq. 3) | 100 |
| DVD1625 | IL-1B (seq. 4) | IL-17 (seq. 1) | 93.9 |
| DVD1626 | IL-17 (seq. 1) | IL-1B (seq. 4) | 96.7 |
| DVD1627 | IL-1B (seq. 5) | IL-17 (seq. 1) | 95.4 |
| DVD1628 | IL-17 (seq. 1) | IL-1B (seq. 5) | 97.9 |
| DVD1629 | IL-1B (seq. 1) | IL-17 (seq. 2) | 100 |
| DVD1630 | IL-17 (seq. 2) | IL-1B (seq. 1) | 65.3 |
| DVD1631 | IL-1B (seq. 2) | IL-17 (seq. 2) | 100 |
| DVD1632 | IL-17 (seq. 2) | IL-1B (seq. 2) | 61.6 |
| DVD1633 | IL-1B (seq. 3) | IL-17 (seq. 2) | 93.4 |
| DVD1634 | IL-17 (seq. 2) | IL-1B (seq. 3) | 76.7 |
| DVD1635 | IL-1B (seq. 4) | IL-17 (seq. 2) | 98.6 |
| DVD1636 | IL-17 (seq. 2) | IL-1B (seq. 4) | 75.7 |
| DVD1637 | IL-1B (seq. 5) | IL-17 (seq. 2) | 98.6 |
| DVD1638 | IL-17 (seq. 2) | IL-1B (seq. 5) | 69.3 |
| DVD1639 | IL-1B (seq. 1) | IL-17 (seq. 3) | 100 |
| DVD1640 | IL-17 (seq. 3) | IL-1B (seq. 1) | 100 |
| DVD1641 | IL-1B (seq. 2) | IL-17 (seq. 3) | 100 |
| DVD1642 | IL-17 (seq. 3) | IL-1B (seq. 2) | 100 |
| DVD1643 | IL-1B (seq. 3) | IL-17 (seq. 3) | 93.3 |
| DVD1644 | IL-17 (seq. 3) | IL-1B (seq. 3) | 100 |
| DVD1645 | IL-1B (seq. 4) | IL-17 (seq. 3) | 100 |
| DVD1646 | IL-17 (seq. 3) | IL-1B (seq. 4) | 100 |
| DVD1647 | IL-1B (seq. 5) | IL-17 (seq. 3) | 98.1 |
| DVD1648 | IL-17 (seq. 3) | IL-1B (seq. 5) | 100 |

DVD-Igs showed an excellent SEC profile with most DVD-Igs showing >90% monomer. This DVD-ig profile is similar to that observed for parent antibodies.

SDS-PAGE

Antibodies are analyzed by sodium dodecyl sulfate-polyacrylamide gel electrophoresis (SDS-PAGE) under both reducing and non-reducing conditions. Adalimumab lot AFP04C is used as a control. For reducing conditions, the samples are mixed 1:1 with 2× tris glycine SDS-PAGE sample buffer (Invitrogen, cat#LC2676, lot#1323208) with 100 mM DTT, and heated at 60° C. for 30 minutes. For non-reducing conditions, the samples are mixed 1:1 with sample buffer and heated at 100° C. for 5 minutes. The reduced samples (10 mg per lane) are loaded on a 12% pre-cast tris-glycine gel (Invitrogen, cat#EC6005box, lot#6111021), and the non-reduced samples (10 mg per lane) are loaded on an 8%-16% pre-cast tris-glycine gel (Invitrogen, cat#EC6045box, lot#6111021). SeeBlue Plus 2 (Invitrogen, cat#LC5925, lot#1351542) is used as a molecular weight marker. The gels are run in a XCell SureLock mini cell gel box (Invitrogen, cat#EI0001) and the proteins are separated by first applying a voltage of 75 to stack the samples in the gel, followed by a constant voltage of 125 until the dye front reached the bottom of the gel. The running buffer used is 1× tris glycine SDS buffer, prepared from a 10× tris glycine SDS buffer (ABC, MPS-79-080106)). The gels are stained overnight with colloidal blue stain (Invitrogen cat#46-7015, 46-7016) and destained with Milli-Q water until the background is clear. The stained gels are then scanned using an Epson Expression scanner (model 1680, S/N DASX003641).

Sedimentation Velocity Analysis

Antibodies are loaded into the sample chamber of each of three standard two-sector carbon epon centerpieces. These centerpieces have a 1.2 cm optical path length and are built with sapphire windows. PBS is used for a reference buffer and each chamber contained 140 μL. All samples are examined simultaneously using a 4-hole (AN-60Ti) rotor in a Beckman ProteomeLab XL-I analytical ultracentrifuge (serial #PL106C01).

Run conditions are programmed and centrifuge control is performed using ProteomeLab (v5.6). The samples and rotor are allowed to thermally equilibrate for one hour prior to analysis (20.0±0.1° C.). Confirmation of proper cell loading is performed at 3000 rpm and a single scan is recorded for each cell. The sedimentation velocity conditions are the following:

Sample Cell Volume: 420 mL
Reference Cell Volume: 420 mL
Temperature: 20° C.
Rotor Speed: 35,000 rpm
Time: 8:00 hours
UV Wavelength: 280 nm
Radial Step Size: 0.003 cm
Data Collection One data point per step without signal averaging.
Total Number of Scans: 100

LC-MS Molecular Weight Measurement of Intact Antibodies

Molecular weights of intact antibodies are analyzed by LC-MS. Each antibody is diluted to approximately 1 mg/mL with water. An 1100 HPLC (Agilent) system with a protein microtrap (Michrom Bioresources, Inc, cat#004/25109/03) is used to desalt and introduce 5 mg of the sample into an API Qstar pulsar i mass spectrometer (Applied Biosystems). A short gradient is used to elute the samples. The gradient is run with mobile phase A (0.08% FA, 0.02% TFA in HPLC water) and mobile phase B (0.08% FA and 0.02% TFA in acetonitrile) at a flow rate of 50 mL/minute. The mass spectrometer is operated at 4.5 kvolts spray voltage with a scan range from 2000 to 3500 mass to charge ratio.

LC-MS Molecular Weight Measurement of Antibody Light and Heavy Chains

Molecular weight measurement of antibody light chain (LC), heavy chain (HC) and deglycosylated HC are analyzed by LC-MS. Antibody is diluted to 1 mg/mL with water and the sample is reduced to LC and HC with a final concentration of 10 mM DTT for 30 minutes at 37° C. To deglycosylate the antibody, 100 mg of the antibody is incubated with 2 mL of PNGase F, 5 mL of 10% N-octylglucoside in a total volume of 100 mL overnight at 37° C. After deglycosylation the sample is reduced with a final concentration of 10 mM DTT for 30 minutes at 37° C. An Agilent 1100 HPLC system with a C4 column (Vydac, cat#214TP5115, S/N 060206537204069) is used to desalt and introduce the sample (5 mg) into an API Qstar pulsar i mass spectrometer (Applied Biosystems). A short gradient is used to elute the sample. The gradient is run with mobile phase A (0.08% FA, 0.02% TFA in HPLC water) and mobile phase B (0.08% FA and 0.02% TFA in acetonitrile) at a flow rate of 50 mL/minute. The mass spectrometer is operated at 4.5 kvolts spray voltage with a scan range from 800 to 3500 mass to charge ratio.

Peptide Mapping

Antibody is denatured for 15 minutes at room temperature with a final concentration of 6 M guanidine hydrochloride in 75 mM ammonium bicarbonate. The denatured samples are reduced with a final concentration of 10 mM DTT at 37° C. for 60 minutes, followed by alkylation with 50 mM iodoacetic acid (IAA) in the dark at 37° C. for 30 minutes. Following alkylation, the sample is dialyzed overnight against four liters of 10 mM ammonium bicarbonate at 4° C. The dialyzed sample is diluted to 1 mg/mL with 10 mM ammonium bicarbonate, pH 7.8 and 100 mg of antibody is either digested with trypsin (Promega, cat#V5111) or Lys-C (Roche, cat#11 047 825 001) at a 1:20 (w/w) trypsin/Lys-C:antibody ratio at 37° C. for 4 hrs. Digests are quenched with 1 mL of 1 N HCl. For peptide mapping with mass spectrometer detection, 40 mL of the digests are separated by reverse phase high performance liquid chromatography (RPHPLC) on a C18 column (Vydac, cat#218TP51, S/N NE9606 10.3.5) with an Agilent 1100 HPLC system. The peptide separation is run with a gradient using mobile phase A (0.02% TFA and 0.08% FA in HPLC grade water) and mobile phase B (0.02% TFA and 0.08% FA in acetonitrile) at a flow rate of 50 mL/minutes. The API QSTAR Pulsar i mass spectromer is operated in positive mode at 4.5 kvolts spray voltage and a scan range from 800 to 2500 mass to charge ratio.

Disulfide Bond Mapping

To denature the antibody, 100 mL of the antibody is mixed with 300 mL of 8 M guanidine HCl in 100 mM ammonium bicarbonate. The pH is checked to ensure that it is between 7 and 8 and the samples are denatured for 15 minutes at room temperature in a final concentration of 6 M guanidine HCl. A portion of the denatured sample (100 mL) is diluted to 600 mL with Milli-Q water to give a final guanidine-HCl concentration of 1M. The sample (220 mg) is digested with either trypsin (Promega, cat #V5111, lot#22265901) or Lys-C (Roche, cat#11047825001, lot#12808000) at a 1:50 trypsin or 1:50 Lys-C: antibody (w/w) ratios (4.4 mg enzyme: 220 mg sample) at 37° C. for approximately 16 hours. An additional 5 mg of trypsin or Lys-C is added to the samples and digestion is allowed to proceed for an additional 2 hours at 37° C. Digestions are stopped by adding 1 mL of TFA to each sample. Digested samples are separated by RPHPLC using a C18 column (Vydac, cat#218TP51 S/N NE020630-4-1A) on an Agilent HPLC system. The separation is run with the same gradient used for peptide mapping using mobile phase A (0.02% TFA and 0.08% FA in HPLC grade water) and mobile phase B (0.02% TFA and 0.08% FA in acetonitrile) at a flow rate of 50 mL/minute. The HPLC operating conditions are the same as those used for peptide mapping. The API QSTAR Pulsar i mass spectromer is operated in positive mode at 4.5 kvolts spray voltage and a scan range from 800 to 2500 mass-to-charge ratio. Disulfide bonds are assigned by matching the observed MWs of peptides with the predicted MWs of tryptic or Lys-C peptides linked by disulfide bonds.

Free Sulfhydryl Determination

The method used to quantify free cysteines in an antibody is based on the reaction of Ellman's reagent, 5,5¢-dithiobis(2-nitrobenzoic acid) (DTNB), with sulfhydryl groups (SH) which gives rise to a characteristic chromophoric product, 5-thio-(2-nitrobenzoic acid) (TNB). The reaction is illustrated in the formula:

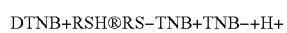

DTNB+RSH®RS-TNB+TNB-+H+

The absorbance of the TNB- is measured at 412 nm using a Cary 50 spectrophotometer. An absorbance curve is plotted using dilutions of 2 mercaptoethanol (b-ME) as the free SH standard and the concentrations of the free sulfhydryl groups in the protein are determined from absorbance at 412 nm of the sample.

The b-ME standard stock is prepared by a serial dilution of 14.2 M b-ME with HPLC grade water to a final concentration of 0.142 mM. Then standards in triplicate for each concentration are prepared. Antibody is concentrated to 10 mg/mL using an amicon ultra 10,000 MWCO centrifugal filter (Millipore, cat#UFC801096, lot#L3KN5251) and the buffer is changed to the formulation buffer used for adalimumab (5.57 mM sodium phosphate monobasic, 8.69 mM sodium phosphate dibasic, 106.69 mM NaCl, 1.07 mM sodium citrate, 6.45 mM citric acid, 66.68 mM mannitol, pH 5.2, 0.1% (w/v) Tween). The samples are mixed on a shaker at room temperature for 20 minutes. Then 180 mL of 100 mM Tris buffer, pH 8.1 is added to each sample and standard followed by the addition of 300 mL of 2 mM DTNB in 10 mM phosphate buffer, pH 8.1. After thorough mixing, the samples and standards are measured for absorption at 412 nm on a Cary 50 spectrophotometer. The standard curve is obtained by plotting the amount of free SH and $OD_{412}$ nm of the b-ME standards. Free SH content of samples are calculated based on this curve after subtraction of the blank.

Weak Cation Exchange Chromatography

Antibody is diluted to 1 mg/mL with 10 mM sodium phosphate, pH 6.0. Charge heterogeneity is analyzed using a Shimadzu HPLC system with a WCX-10 ProPac analytical column (Dionex, cat#054993, S/N 02722). The samples are loaded on the column in 80% mobile phase A (10 mM sodium phosphate, pH 6.0) and 20% mobile phase B (10 mM sodium phosphate, 500 mM NaCl, pH 6.0) and eluted at a flow rate of 1.0 mL/minute.

Oligosaccharide Profiling

Oligosaccharides released after PNGase F treatment of antibody are derivatized with 2-aminobenzamide (2-AB) labeling reagent. The fluorescent-labeled oligosaccharides are separated by normal phase high performance liquid chromatography (NPHPLC) and the different forms of oligosaccharides are characterized based on retention time comparison with known standards.

The antibody is first digested with PNGaseF to cleave N-linked oligosaccharides from the Fc portion of the heavy chain. The antibody (200 mg) is placed in a 500 mL Eppendorf tube along with 2 mL PNGase F and 3 mL of 10% N-octylglucoside. Phosphate buffered saline is added to bring the final volume to 60 mL. The sample is incubated overnight at 37° C. in an Eppendorf thermomixer set at 700 RPM. Adalimumab lot AFP04C is also digested with PNGase F as a control.

After PNGase F treatment, the samples are incubated at 95° C. for 5 minutes in an Eppendorf thermomixer set at 750 RPM to precipitate out the proteins, then the samples are placed in an Eppendorf centrifuge for 2 minutes at 10,000 RPM to spin down the precipitated proteins. The supernatant containing the oligosaccharides are transferred to a 500 mL Eppendorf tube and dried in a speed-vac at 65° C.

The oligosaccharides are labeled with 2AB using a 2AB labeling kit purchased from Prozyme (cat#GKK-404, lot#132026). The labeling reagent is prepared according to the manufacturer's instructions. Acetic acid (150 mL, provided in kit) is added to the DMSO vial (provided in kit) and mixed by pipeting the solution up and down several times.

The acetic acid/DMSO mixture (100 mL) is transferred to a vial of 2-AB dye (just prior to use) and mixed until the dye is fully dissolved. The dye solution is then added to a vial of reductant (provided in kit) and mixed well (labeling reagent). The labeling reagent (5 mL) is added to each dried oligosaccharide sample vial, and mixed thoroughly. The reaction vials are placed in an Eppendorf thermomixer set at 65° C. and 700-800 RPM for 2 hours of reaction.

After the labeling reaction, the excess fluorescent dye is removed using GlycoClean S Cartridges from Prozyme (cat#GKI-4726). Prior to adding the samples, the cartridges are washed with 1 mL of milli-Q water followed with 5 washes of 1 mL 30% acetic acid solution. Just prior to adding the samples, 1 mL of acetonitrile (Burdick and Jackson, cat#AH015-4) is added to the cartridges.

After all of the acetonitrile passed through the cartridge, the sample is spotted onto the center of the freshly washed disc and allowed to adsorb onto the disc for 10 minutes. The disc is washed with 1 mL of acetonitrile followed by five washes of 1 mL of 96% acetonitrile. The cartridges are placed over a 1.5 mL Eppendorf tube and the 2-AB labeled oligosaccharides are eluted with 3 washes (400 mL each wash) of milli Q water.

The oligosaccharides are separated using a Glycosep N HPLC (cat#GKI-4728) column connected to a Shimadzu HPLC system. The Shimadzu HPLC system consisted of a system controller, degasser, binary pumps, autosampler with a sample cooler, and a fluorescent detector.

Stability at Elevated Temperatures

The buffer of antibody is either 5.57 mM sodium phosphate monobasic, 8.69 mM sodium phosphate dibasic, 106.69 mM NaCl, 1.07 mM sodium citrate, 6.45 mM citric acid, 66.68 mM mannitol, 0.1% (w/v) Tween, pH 5.2; or 10 mM histidine, 10 mM methionine, 4% mannitol, pH 5.9 using Amicon ultra centrifugal filters. The final concentration of the antibodies is adjusted to 2 mg/mL with the appropriate buffers. The antibody solutions are then filter sterilized and 0.25 mL aliquots are prepared under sterile conditions. The aliquots are left at either −80° C., 5° C., 25° C., or 40° C. for 1, 2 or 3 weeks. At the end of the incubation period, the samples are analyzed by size exclusion chromatography and SDS-PAGE.

The stability samples are analyzed by SDS-PAGE under both reducing and non-reducing conditions. The procedure used is the same as described herein. The gels are stained overnight with colloidal blue stain (Invitrogen cat#46-7015, 46-7016) and destained with Milli-Q water until the background is clear. The stained gels are then scanned using an Epson Expression scanner (model 1680, S/N DASX003641). To obtain more sensitivity, the same gels are silver stained using silver staining kit (Owl Scientific) and the recommended procedures given by the manufacturer is used.

Dynamic Scanning Fluorimetry

The DVD's were dialysed in 10 mM citrate 10 mM phosphate buffer, pH 6.0 to get a final concentration of 1 mg/ml. Triplicates were run for each DVD. For each sample, 27 μl of the DVD was added in a well of a 96 well plate and mixed with 3 μl of 4× diluted SYPRO Orange dye (Invitrogen). The dye is supplied in DMSO at a concentration of 5000× and was diluted to the working concentration of 4× in water. The plate was centrifuged for 30 sec to ensure that both the dye and the protein settle to the bottom of the wells and complete mixing was ensured by gentle aspiration by a pipette tip. The plate was then sealed with an adhesive film.

A real time PCR (Applied Biosciences, 7500 Series) was used for measuring the change in fluorescence intensities with temperature. The plate was heated from 25° C. to 95° C. at a temperature ramp rate of approximately 0.5° C./min and emission fluorescence was collected using TAMRA filter. The data was exported to Microsoft Excel and plotted as temperature vs fluorescence for each DVD. Onset of melting was noted as the temperature where the thermogram rises above the baseline fluorescence. SYPRO Orange is a hydrophobic dye and preferentially binds to the exposed hydrophobic residues in an unfolded protein molecule. Hence the onset of unfolding temperature, as measured by an increase in fluorescence is an indication of the thermal stability of the DVD. The unfolding temperature for the DVD-Igs can be found in Table 9.

TABLE 9

Thermal Stability of Parent Antibodies and CDR-grafted DVD-Ig Constructs as Determined by Dynamic Scanning Fluorimetry

| Parent Antibody or DVD-Ig ID | N-terminal Variable Domain (VD) | C-terminal Variable Domain (VD) | Onset of melting (rank) (deg C.) |
|---|---|---|---|
| DVD1262 | IL-1B (seq. 1) | IL-17 (seq. 1) | 57 |
| DVD1264 | IL-1B (seq. 2) | IL-17 (seq. 1) | 58 |
| DVD1265 | IL-17 (seq. 1) | IL-1B (seq. 2) | 50 |
| DVD1266 | IL-1B (seq. 3) | IL-17 (seq. 1) | 59 |
| DVD1268 | IL-1B (seq. 4) | IL-17 (seq. 1) | 55 |
| DVD1270 | IL-1B (seq. 5) | IL-17 (seq. 1) | 58 |
| DVD1272 | IL-1B (seq. 1) | IL-17 (seq. 2) | 64 |
| DVD1278 | IL-1B (seq. 4) | IL-17 (seq. 2) | 59 |
| DVD1280 | IL-1B (seq. 5) | IL-17 (seq. 2) | 59 |
| DVD1286 | IL-1B (seq. 3) | IL-17 (seq. 3) | 60 |
| DVD1288 | IL-1B (seq. 4) | IL-17 (seq. 3) | 57 |
| DVD1290 | IL-1B (seq. 5) | IL-17 (seq. 3) | 59 |
| DVD1593 | IL-1B (seq. 3) | IL-17 (seq. 1) | 42 |
| DVD1595 | IL-1B (seq. 4) | IL-17 (seq. 1) | 44 |
| DVD1597 | IL-1B (seq. 5) | IL-17 (seq. 1) | 57 |
| DVD1599 | IL-1B (seq. 1) | IL-17 (seq. 2) | 59 |
| DVD1600 | IL-17 (seq. 2) | IL-1B (seq. 1) | 52 |
| DVD1601 | IL-1B (seq. 2) | IL-17 (seq. 2) | 60 |
| DVD1602 | IL-17 (seq. 2) | IL-1B (seq. 2) | 52 |
| DVD1609 | IL-1B (seq. 1) | IL-17 (seq. 3) | 58 |
| DVD1611 | IL-1B (seq. 2) | IL-17 (seq. 3) | 58 |
| DVD1612 | IL-17 (seq. 3) | IL-1B (seq. 2) | 47 |
| DVD1613 | IL-1B (seq. 3) | IL-17 (seq. 3) | 56 |
| DVD1614 | IL-17 (seq. 3) | IL-1B (seq. 3) | 44 |
| DVD1615 | IL-1B (seq. 4) | IL-17 (seq. 3) | 52 |
| DVD1617 | IL-1B (seq. 5) | IL-17 (seq. 3) | 57 |
| DVD1623 | IL-1B (seq. 3) | IL-17 (seq. 1) | 51 |
| DVD1625 | IL-1B (seq. 4) | IL-17 (seq. 1) | 55 |
| DVD1627 | IL-1B (seq. 5) | IL-17 (seq. 1) | 53 |
| DVD1629 | IL-1B (seq. 1) | IL-17 (seq. 2) | 61 |
| DVD1631 | IL-1B (seq. 2) | IL-17 (seq. 2) | 60 |
| DVD1632 | IL-17 (seq. 2) | IL-1B (seq. 2) | 53 |
| DVD1635 | IL-1B (seq. 4) | IL-17 (seq. 2) | 56 |
| DVD1637 | IL-1B (seq. 5) | IL-17 (seq. 2) | 56 |
| DVD1639 | IL-1B (seq. 1) | IL-17 (seq. 3) | 61 |
| DVD1642 | IL-17 (seq. 3) | IL-1B (seq. 2) | 50 |
| DVD1645 | IL-1B (seq. 4) | IL-17 (seq. 3) | 58 |
| DVD1647 | IL-1B (seq. 5) | IL-17 (seq. 3) | 58 |

Most DVD-Igs showed an unfolding temperature >50. This DVD-Ig profile is similar to that observed for parent antibodies.

Solubility Determination

DVD candidates were dialyzed in 15 mM His, pH 6.0. This was followed by concentrating them up to 50 μl in centricons with a 30K cutoff. Solubility was visually confirmed by absence of precipitation after storage at 4° C. and quantitatively determined by UV absorbance measurement at 280 nm.

TABLE 10

Solubility of DVD-Ig Constructs as Determined by UV Absorbance

| Parent Antibody or DVD-Ig ID | N-terminal Variable Domain (VD) | C-terminal Variable Domain (VD) | Solubility (rank) 15 mM His, pH 6 | |
|---|---|---|---|---|
| | | | Appearance | mg/ml |
| DVD1262 | IL-1B (seq. 1) | IL-17 (seq. 1) | clear | >28 |
| DVD1264 | IL-1B (seq. 2) | IL-17 (seq. 1) | ppt | 21 |
| DVD1265 | IL-17 (seq. 1) | IL-1B (seq. 2) | opalascent | 7 |
| DVD1266 | IL-1B (seq. 3) | IL-17 (seq. 1) | phase separation | 17 |
| DVD1268 | IL-1B (seq. 4) | IL-17 (seq. 1) | opalascent | 5 |
| DVD1270 | IL-1B (seq. 5) | IL-17 (seq. 1) | opalascent | |
| DVD1272 | IL-1B (seq. 1) | IL-17 (seq. 2) | clear | >127 |
| DVD1278 | IL-1B (seq. 4) | IL-17 (seq. 2) | phase separation | 14 |
| DVD1280 | IL-1B (seq. 5) | IL-17 (seq. 2) | clear | >133 |
| DVD1286 | IL-1B (seq. 3) | IL-17 (seq. 3) | clear | >99 |
| DVD1288 | IL-1B (seq. 4) | IL-17 (seq. 3) | clear | >130 |
| DVD1290 | IL-1B (seq. 5) | IL-17 (seq. 3) | clear | >80 |
| DVD1593 | IL-1B (seq. 3) | IL-17 (seq. 1) | ppt | |
| DVD1595 | IL-1B (seq. 4) | IL-17 (seq. 1) | ppt | 15 |
| DVD1597 | IL-1B (seq. 5) | IL-17 (seq. 1) | ppt | |
| DVD1599 | IL-1B (seq. 1) | IL-17 (seq. 2) | clear | >99 |
| DVD1600 | IL-17 (seq. 2) | IL-1B (seq. 1) | opalascent | |
| DVD1601 | IL-1B (seq. 2) | IL-17 (seq. 2) | clear | >129 |
| DVD1602 | IL-17 (seq. 2) | IL-1B (seq. 2) | opalascent | 5 |
| DVD1609 | IL-1B (seq. 1) | IL-17 (seq. 3) | clear | >59 |
| DVD1611 | IL-1B (seq. 2) | IL-17 (seq. 3) | clear | >79 |
| DVD1612 | IL-17 (seq. 3) | IL-1B (seq. 2) | clear | >35 |
| DVD1613 | IL-1B (seq. 3) | IL-17 (seq. 3) | clear | >67 |
| DVD1614 | IL-17 (seq. 3) | IL-1B (seq. 3) | ppt | 10 |
| DVD1615 | IL-1B (seq. 4) | IL-17 (seq. 3) | phase separation | 19 |
| DVD1617 | IL-1B (seq. 5) | IL-17 (seq. 3) | clear | >123 |
| DVD1623 | IL-1B (seq. 3) | IL-17 (seq. 1) | phase separation | 22 |
| DVD1625 | IL-1B (seq. 4) | IL-17 (seq. 1) | opalascent | 25 |
| DVD1627 | IL-1B (seq. 5) | IL-17 (seq. 1) | phase separation | |
| DVD1629 | IL-1B (seq. 1) | IL-17 (seq. 2) | clear | >101 |
| DVD1631 | IL-1B (seq. 2) | IL-17 (seq. 2) | clear | >104 |
| DVD1632 | IL-17 (seq. 2) | IL-1B (seq. 2) | clear | >79 |
| DVD1635 | IL-1B (seq. 4) | IL-17 (seq. 2) | ppt | |
| DVD1637 | IL-1B (seq. 5) | IL-17 (seq. 2) | clear | >34 |
| DVD1639 | IL-1B (seq. 1) | IL-17 (seq. 3) | clear | >49 |
| DVD1642 | IL-17 (seq. 3) | IL-1B (seq. 2) | clear | >70 |
| DVD1645 | IL-1B (seq. 4) | IL-17 (seq. 3) | phase separation | 20 |
| DVD1647 | IL-1B (seq. 5) | IL-17 (seq. 3) | clear | >50 |

Most DVD-Igs showed clear appearance and could be concentrated to greater than 25 mg/ml. This DVD-Ig profile is similar to that observed for parent antibodies.

Example 1.2.2.3.C

Efficacy of a Humanized Monoclonal Antibody by Itself or in Combination with Chemotherapy on the Growth of Human Carcinoma Xenografts Human cancer cells are grown in vitro to 99% viability, 85% confluence in tissue culture flasks. SCID female or male mice (Charles Rivers Labs) at 19-25 grams, are ear tagged and shaved. Mice are then inoculated subcutaneously into the right flank with 0.2 ml of $2 \times 10^6$ human tumor cells (1:1 matrigel) on study day 0. Administration (IP, Q3D/week) of vehicle (PBS), humanized antibody, and/or chemotherapy is initiated after mice are size matched into separate cages of mice with mean tumor volumes of approximately 150 to 200 mm³. The tumors are measured by a pair of calipers twice a week starting on approximately day 10 post inoculation and the tumor volumes calculated according to the formula $V = L \times W^2/2$ (V: volume, mm³; L: length, mm; W: width, m). Reduction in tumor volume is seen in animals treated with mAb alone or in combination with chemotherapy relative to tumors in animals that received only vehicle or an isotype control mAb.

Example 1.2.2.3.D

FACS Based Redirected Cytotoxicity (rCTL) Assay

Human CD3+ T cells qre isolated from previously frozen isolated peripheral blood mononuclear cells (PBMC) by a negative selection enrichment column (R&D Systems, Minneapolis, Minn.; Cat. #HTCC-525). T cells are stimulated for 4 days in flasks (vent cap, Corning, Acton, Mass.) coated with 10 µg/mL anti-CD3 (OKT-3, eBioscience, Inc., San Diego, Calif.) and 2 µg/mL anti-CD28 (CD28.2, eBioscience, Inc., San Diego, Calif.) in D-PBS (Invitrogen, Carlsbad, Calif.) and cultured in 30 U/mL IL-2 (Roche) in complete RPMI 1640 media (Invitrogen, Carlsbad, Calif.) with L-glutamine, 55 mM β-ME, Pen/Strep, 10% FBS). T cells are then rested overnight in 30 U/mL IL-2 before using in assay. DoHH2 or Raji target cells are labeled with PKH26 (Sigma-Aldrich, St. Louis, Mo.) according to manufacturer's instructions. RPMI 1640 media (no phenol, Invitrogen, Carlsbad, Calif.) containing L-glutamine and 10% FBS (Hyclone, Logan, Utah) is used throughout the rCTL assay. (See Dreier et al. (2002) Int J Cancer 100:690).

Effector T cells (E) and targets (T) are plated at a final cell concentration of $10^5$ and $10^4$ cells/well in 96-well plates (Costar #3799, Acton, Mass.), respectively to give an E:T ratio of 10:1. DVD-Ig molecules are diluted to obtain concentration-dependent titration curves. After an overnight incubation cells are pelleted and washed with D-PBS once before resuspending in FACS buffer containing 0.1% BSA (Invitrogen, Carlsbad, Calif.), 0.1% sodium azide and 0.5 µg/mL propidium iodide (BD) in D-PBS. FACS data is collected on a FACS Canto II machine (Becton Dickinson, San Jose, Calif.) and analyzed in Flowjo (Treestar). The percent live targets in the DVD-Ig treated samples divided by the percent total targets (control, no treatment) is calculated to determine percent specific lysis. IC50s are calculated in Prism (Graphpad).

Example 1.2.2.3.E

Antibody-Dependent Cell Mediated Cytotoxicity (ADCC) Method

Target (DoHH2, A431, and U87MGde2-7) cells were harvested and washed with 10 mL RPMI no phenol red medium (Invitrogen, Carlsbad, Calif., Cat. #11835) and incubated in calcein-AM (eBioscience, San Diego, Calif., Cat. #65-0853) at a concentration of $4 \times 10^6$ cells/mL for 30 minutes. Target cells were washed 3 times with 10 mL RPMI no phenol red 10% FBS (Thermo Scientific HyClone, Logan, Utah, Cat. #SH30070.03) and aliquoted at 180,000 cells/well in a 96-well round bottom plate. Antibodies and DVD-Igs were diluted in RPMI no phenol red 10% FBS to 10 µg/mL. The supernatant is removed from the target cells, and 30 µL/well of the diluted antibodies and DVD-Igs were added. Cells were incubated on ice for 1 hour and then washed 3 times with 150 µL/well RPMI no phenol red 10% FBS. Cells were transferred to a 2 mL assay block and resuspended at a concentration of $1.33 \times 10^5$ cells/mL. Unactivated human NK cells (Astarte Biologics, Redmond, Wash., Cat. #1027) or activated human NK cells (In-house blood donor program PBMCs activated 2 weeks using kit, Myltenyi Biotech, Auburn, Calif., Cat. #130-094-483) were thawed, washed with 10 mL RPMI no phenol red 10% FBS twice, and resuspended at 1.2×10⁶ cells/mL. NK cells and target cells were then aliquoted at a ratio of 9:1 onto 96-well V bottom plate by transferring 75 µL of NK cells and 75 µL of target cells to the same well. Media is added instead of NK cells for wells that were used to determine spontaneous calcein-AM release. 2% triton (Sigma-Aldrich, St. Louis, Mo., Cat. #93443) is added instead of NK cells to wells that were used to determine total lysis. All conditions were plated in triplicate.

Cells were incubated for 2-2.5 hours at 37° C. and then spun down at 1300 rpm for 5 minutes. 100 µL/well of supernatant is transferred to black cliniplates. Plates were read on a 2103 EnVision Multilabel Reader (Perkin Elmer, Waltham, Mass.)

Example 1.2.2.3.F

FcR Binding Method

Cells (FcRn: FcRnGPI-CHO, FcγRI: THP-1, FcγRIIa: K562, FcγRIIb: CHO-FcγRII-b-1) were plated at 1×10⁵ cells/well on a 96 well round bottom plate. Antibodies and DVD-Igs were diluted 100 µg/ml in FACS buffer (1% FBS in PBS pH6.4 for FcRn samples, pH7.4 for the rest). The supernatant was removed from the cells and 30 µL of diluted antibodies and DVD-Igs was added to well. Cells were incubated with the antibodies at 4° C. for 2 hours. Following incubation, the cells were washed three times with 150 µL FACS buffer (pH 6.4 for FcRn samples, pH 7.4 for the rest). The cells were resuspended in 50 µL FACS buffer (pH 6.4 for FcRn samples, pH 7.4 for the rest) with 1:125 diluted R-PE conjugated anti-human IgG F(Ab')₂ (Jackson ImmunoResearch, West Grove, Pa., Cat. #109-116-170) and incubated at 4° C. for 40 minutes. Cells were washed three times, and finally resuspended in 100 µL FACS buffer (pH 6.4 for FcRn samples, pH 7.4 for the rest). Samples were run on a FACSCalibur machine (Becton Dickinson, San Jose, Calif.). FACSCalibur settings for FL2 were adjusted such that a non-antibody-treated control sample had a GMFI of 3. Experimental samples were run subsequently. FlowJo software (Treestar, Inc, Ashland, Oreg.) was used to analyze the data and determine R-PE GMFI on live cells as designated by a forward and side scatter gate.

Example 1.4

Generation of a DVD-Ig

DVD-Ig molecules that bind two antigens are constructed using two parent monoclonal antibodies, one against human antigen A, and the other against human antigen B, selected as described herein.

Example 1.4.1

Generation of a DVD-Ig Having Two Linker Lengths

A constant region containing µ1 Fc with mutations at 234, and 235 to eliminate ADCC/CDC effector functions was used. Four different anti-A/B DVD-Ig constructs were generated: 2 with short linker (SL) and 2 with long linker (LL), each in two different domain orientations: $V_A$-$V_B$-C and $V_B$-$V_A$-C (see Table 11). The linker sequences, derived from the N-terminal sequence of human Cl/Ck or CH1 domain, were as follows:

For DVDAB constructs:

```
light chain (if anti-A has λ):
                                    (SEQ ID NO: 15)
Short linker: QPKAAP;
                                    (SEQ ID NO: 16)
Long linker: QPKAAPSVTLFPP light chain (if anti-A has κ):
                                    (SEQ ID NO: 13)
Short linker: TVAAP;
                                    (SEQ ID NO: 14)
Long linker: TVAAPSVFIFPP heavy chain (γ1):
                                    (SEQ ID NO: 21)
Short linker: ASTKGP;
                                    (SEQ ID NO: 22)
Long linker: ASTKGPSVFPLAP
```

For DVDBA constructs:

```
light chain (if anti-B has λ):
                                    (SEQ ID NO: 15)
Short linker: QPKAAP;
                                    (SEQ ID NO: 16)
Long linker: QPKAAPSVTLFPP light chain (if anti-B has k):
                                    (SEQ ID NO: 13)
Short linker: TVAAP;
                                    (SEQ ID NO: 14)
Long linker: TVAAPSVFIFPP heavy chain (γ1):
                                    (SEQ ID NO: 21)
Short linker: ASTKGP;
                                    (SEQ ID NO: 22)
Long linker: ASTKGPSVFPLAP
```

Heavy and light chain constructs were subcloned into the pBOS expression vector, and expressed in COS cells, followed by purification by Protein A chromatography. The purified materials were subjected to SDS-PAGE and SEC analysis.

Table 11 describes the heavy chain and light chain constructs used to express each anti-A/B DVD-Ig protein.

TABLE 11

Anti-A/B DVD-Ig Constructs

| DVD-Ig protein | Heavy chain construct | Light chain construct |
|---|---|---|
| DVDABSL | DVDABHC-SL | DVDABLC-SL |
| DVDABLL | DVDABHC-LL | DVDABLC-LL |
| DVDBASL | DVDBAHC-SL | DVDBALC-SL |
| DVDBALL | DVDBAHC-LL | DVDBALC-LL |

Example 1.4.2

Molecular Cloning of DNA Constructs for DVDABSL and DVDABLL

To generate heavy chain constructs DVDABHC-LL and DVDABHC-SL, VH domain of A antibody is PCR amplified using specific primers (3' primers contain short/long linker sequence for SL/LL constructs, respectively); meanwhile VH domain of B antibody is amplified using specific primers (5' primers contains short/long linker sequence for SL/LL constructs, respectively). Both PCR reactions are performed according to standard PCR techniques and procedures. The two PCR products are gel-purified, and used together as overlapping template for the subsequent overlapping PCR reaction. The overlapping PCR products are subcloned into Srf I and Sal I double digested pBOS-hCγ1,z non-a mammalian expression vector (Abbott) by using standard homologous recombination approach.

To generate light chain constructs DVDABLC-LL and DVDABLC-SL, VL domain of A antibody is PCR amplified using specific primers (3' primers contain short/long linker sequence for SL/LL constructs, respectively); meanwhile VL domain of B antibody is amplified using specific primers (5' primers contains short/long linker sequence for SL/LL constructs, respectively). Both PCR reactions are performed according to standard PCR techniques and procedures. The two PCR products are gel-purified, and used together as overlapping template for the subsequent overlapping PCR reaction using standard PCR conditions. The overlapping PCR products are subcloned into Srf I and Not I double digested pBOS-hCk mammalian expression vector (Abbott) by using standard homologous recombination approach. Similar approach has been used to generate DVDBASL and DVDBALL as described below:

Example 1.4.3

Molecular Cloning of DNA Constructs for DVDBASL and DVDBALL

To generate heavy chain constructs DVDBAHC-LL and DVDBAHC-SL, VH domain of antibody B is PCR amplified using specific primers (3' primers contain short/long linker sequence for SL/LL constructs, respectively); meanwhile VH domain of antibody A is amplified using specific primers (5' primers contains short/long linker sequence for SL/LL constructs, respectively). Both PCR reactions are performed according to standard PCR techniques and procedures. The two PCR products are gel-purified, and used together as overlapping template for the subsequent overlapping PCR reaction using standard PCR conditions. The overlapping PCR products are subcloned into Sri I and Sal I double digested pBOS-hCγ1,z non-a mammalian expression vector (Abbott) by using standard homologous recombination approach.

To generate light chain constructs DVDBALC-LL and DVDBALC-SL, VL domain of antibody B is PCR amplified using specific primers (3' primers contain short/long linker sequence for SL/LL constructs, respectively); meanwhile VL domain of A antibody is amplified using specific primers (5' primers contains short/long linker sequence for SL/LL constructs, respectively). Both PCR reactions are performed according to standard PCR techniques and procedures. The two PCR products are gel-purified, and used together as overlapping template for the subsequent overlapping PCR reaction using standard PCR conditions. The overlapping PCR products are subcloned into Srf I and Not I double digested pBOS-hCk mammalian expression vector (Abbott) by using standard homologous recombination approach.

Example 1.4.4

Construction and Expression of Additional DVD-Ig

Example 1.4.4.1

Preparation of DVD-Ig Vector Constructs

Parent antibody amino acid sequences for specific antibodies, which recognize specific antigens or epitopes thereof, for incorporation into a DVD-Ig can be obtained by preparation of hybridomas as described above or can be obtained by sequencing known antibody proteins or nucleic acids. In addition, known sequences can be obtained from the literature. The sequences can be used to synthesize nucleic acids using standard DNA synthesis or amplification technologies and assembling the desired antibody fragments into expression vectors, using standard recombinant DNA technology, for expression in cells.

For example, nucleic acid codons were determined from amino acids sequences and oligonucleotide DNA is synthesized by Blue Heron Biotechnology, Inc, Bothell, Wash. USA. The oligonucleotides were assembled into 300-2,000 base pair double-stranded DNA fragments, cloned into a plasmid vector and sequence-verified. Cloned fragments were assembled using an enzymatic process to yield the complete gene and subcloned into an expression vector. (See U.S. Pat. Nos. 7,306,914; 7,297,541; 7,279,159; 7,150,969; 20080115243; 20080102475; 20080081379; 20080075690; 20080063780; 20080050506; 20080038777; 20080022422; 20070289033; 20070287170; 20070254338; 20070243194; 20070225227; 20070207171; 20070150976; 20070135620; 20070128190; 20070104722; 20070092484; 20070037196; 20070028321; 20060172404; 20060162026; 20060153791; 20030215458; 20030157643).

A group of pHybE vectors (U.S. Patent Application Ser. No. 61/021,282) were used for parental antibody and DVD-Ig cloning. V1, derived from pJP183; pHybE-hCg1,z,non-a V2, was used for cloning of antibody and DVD heavy chains with a wildtype constant region. V2, derived from pJP191; pHybE-hCk V2, was used for cloning of antibody and DVD light chains with a kappa constant region. V3, derived from pJP192; pHybE-hCl V2, was used for cloning of antibody and DVDs light chains with a lambda constant region. V4, built with a lambda signal peptide and a kappa constant region, was used for cloning of DVD light chains with a lambda-kappa hybrid V domain. V5, built with a kappa signal peptide and a lambda constant region, was used for cloning of DVD light chains with a kappa-lambda hybrid V domain. V7, derived from pJP183; pHybE-hCg1,z,non-a V2, was used for cloning of antibody and DVD heavy chains with a (234,235 AA) mutant constant region.

Referring to Table 12, a number of vectors were used in the cloning of the parent antibodies and DVD-Ig VH and VL chains.

TABLE 12

Vectors Used to Clone Parent Antibodies and DVD-Igs

| ID | Heavy chain vector | Light chain vector |
| --- | --- | --- |
| AB268 | V1 | V2 |
| AB269 | V1 | V2 |
| AB270 | V1 | V2 |
| AB271 | V1 | V2 |
| AB272 | V1 | V2 |
| AB273 | V1 | V2 |
| AB274 | V1 | V2 |
| AB275 | V1 | V2 |
| DVD1262 | V1 | V2 |
| DVD1263 | V1 | V2 |
| DVD1264 | V1 | V2 |
| DVD1265 | V1 | V2 |
| DVD1266 | V1 | V2 |
| DVD1267 | V1 | V2 |
| DVD1268 | V1 | V2 |
| DVD1269 | V1 | V2 |
| DVD1270 | V1 | V2 |
| DVD1271 | V1 | V2 |

TABLE 12-continued

Vectors Used to Clone Parent Antibodies and DVD-Igs

| ID | Heavy chain vector | Light chain vector |
|---|---|---|
| DVD1272 | V1 | V2 |
| DVD1273 | V1 | V2 |
| DVD1274 | V1 | V2 |
| DVD1275 | V1 | V2 |
| DVD1276 | V1 | V2 |
| DVD1277 | V1 | V2 |
| DVD1278 | V1 | V2 |
| DVD1279 | V1 | V2 |
| DVD1280 | V1 | V2 |
| DVD1281 | V1 | V2 |
| DVD1282 | V1 | V2 |
| DVD1283 | V1 | V2 |
| DVD1284 | V1 | V2 |
| DVD1285 | V1 | V2 |
| DVD1286 | V1 | V2 |
| DVD1287 | V1 | V2 |
| DVD1288 | V1 | V2 |
| DVD1289 | V1 | V2 |
| DVD1290 | V1 | V2 |
| DVD1291 | V1 | V2 |
| DVD1589 | V1 | V2 |
| DVD1590 | V1 | V2 |
| DVD1591 | V1 | V2 |
| DVD1592 | V1 | V2 |
| DVD1593 | V1 | V2 |
| DVD1594 | V1 | V2 |
| DVD1595 | V1 | V2 |
| DVD1596 | V1 | V2 |
| DVD1597 | V1 | V2 |
| DVD1598 | V1 | V2 |
| DVD1599 | V1 | V2 |
| DVD1600 | V1 | V2 |
| DVD1601 | V1 | V2 |
| DVD1602 | V1 | V2 |
| DVD1603 | V1 | V2 |
| DVD1604 | V1 | V2 |
| DVD1605 | V1 | V2 |
| DVD1606 | V1 | V2 |
| DVD1607 | V1 | V2 |
| DVD1608 | V1 | V2 |
| DVD1609 | V1 | V2 |
| DVD1610 | V1 | V2 |
| DVD1611 | V1 | V2 |
| DVD1612 | V1 | V2 |
| DVD1613 | V1 | V2 |
| DVD1614 | V1 | V2 |
| DVD1615 | V1 | V2 |
| DVD1616 | V1 | V2 |
| DVD1617 | V1 | V2 |
| DVD1618 | V1 | V2 |
| DVD1619 | V1 | V2 |
| DVD1620 | V1 | V2 |
| DVD1621 | V1 | V2 |
| DVD1622 | V1 | V2 |
| DVD1623 | V1 | V2 |
| DVD1624 | V1 | V2 |
| DVD1625 | V1 | V2 |
| DVD1626 | V1 | V2 |
| DVD1627 | V1 | V2 |
| DVD1628 | V1 | V2 |
| DVD1629 | V1 | V2 |
| DVD1630 | V1 | V2 |
| DVD1631 | V1 | V2 |
| DVD1632 | V1 | V2 |
| DVD1633 | V1 | V2 |
| DVD1634 | V1 | V2 |
| DVD1635 | V1 | V2 |
| DVD1636 | V1 | V2 |
| DVD1637 | V1 | V2 |
| DVD1638 | V1 | V2 |
| DVD1639 | V1 | V2 |
| DVD1640 | V1 | V2 |
| DVD1641 | V1 | V2 |
| DVD1642 | V1 | V2 |
| DVD1643 | V1 | V2 |
| DVD1644 | V1 | V2 |
| DVD1645 | V1 | V2 |
| DVD1646 | V1 | V2 |
| DVD1647 | V1 | V2 |
| DVD1648 | V1 | V2 |

Example 1.4.4.2

Transfection and Expression in 293 Cells

The DVD-Ig vector constructs were transfected into 293 cells for production of DVD-Ig protein. The 293 transient transfection procedure used was a modification of the methods published in Durocher et al. (2002) Nucleic Acids Res. 30(2):E9 and Pham et al. (2005) Biotech. Bioengineering 90(3):332-44. Reagents that were used in the transfection included:

HEK 293-6E cells (human embryonic kidney cell line stably expressing EBNA1; obtained from National Research Council Canada) cultured in disposable Erlenmeyer flasks in a humidified incubator set at 130 rpm, 37° C. and 5% $CO_2$.

Culture medium: FreeStyle 293 Expression Medium (Invitrogen 12338-018) plus 25 µg/mL Geneticin (G418) (Invitrogen 10131-027) and 0.1% Pluronic F-68 (Invitrogen 24040-032).

Transfection medium: FreeStyle 293 Expression Medium plus 10 mM HEPES (Invitrogen 15630-080).

Polyethylenimine (PEI) stock: 1 mg/mL sterile stock solution, pH 7.0, prepared with linear 25 kDa PEI (Polysciences) and stored at less than −15° C.

Tryptone Feed Medium: 5% w/v sterile stock of Tryptone N1 (Organotechnie, 19554) in FreeStyle 293 Expression Medium.

Cell preparation for transfection: Approximately 2-4 hours prior to transfection, HEK 293-6E cells were harvested by centrifugation and resuspended in culture medium at a cell density of approximately 1 million viable cells per mL. For each transfection, 40 mL of the cell suspension was transferred into a disposable 250-mL Erlenmeyer flask and incubated for 2-4 hours.

Transfection: The transfection medium and PEI stock were prewarmed to room temperature (RT). For each transfection, 25 µg of plasmid DNA and 50 µg of polyethylenimine (PEI) were combined in 5 mL of transfection medium and incubated for 15-20 minutes at RT to allow the DNA:PEI complexes to form. For the BR3-Ig transfections, 25 µg of BR3-Ig plasmid was used per transfection. Each 5-mL DNA:PEI complex mixture was added to a 40-mL culture prepared previously and returned to the humidified incubator set at 130 rpm, 37° C. and 5% $CO_2$. After 20-28 hours, 5 mL of Tryptone Feed Medium was added to each transfection and the cultures were continued for six days.

The expression profile for the DVD-Igs is shown in Table 13.

TABLE 13

Transient HEK293 Expression Yields of NKG2D Containing Antibodies and DVD-Igs

| DVD ID | N-terminal Variable Domain (VD) | C-terminal Variable Domain (VD) | Expression Yield (mg/L) |
|---|---|---|---|
| AB268 | IL-1B (seq. 1) | | 32 |
| AB269 | IL-1B (seq. 2) | | 27.2 |
| AB270 | IL-1B (seq. 3) | | 52 |
| AB271 | IL-1B (seq. 4) | | 34.2 |
| AB272 | IL-1B (seq. 5) | | 66.6 |
| AB273 | IL-17 (seq. 1) | | 16.6 |
| AB274 | IL-17 (seq. 2) | | 44.6 |
| AB275 | IL-17 (seq. 3) | | 44.2 |
| DVD1262 | IL-1B (seq. 1) | IL-17 (seq. 1) | 29.6 |
| DVD1263 | IL-17 (seq. 1) | IL-1B (seq. 1) | 19 |
| DVD1264 | IL-1B (seq. 2) | IL-17 (seq. 1) | 18.18 |
| DVD1265 | IL-17 (seq. 1) | IL-1B (seq. 2) | 16.86 |
| DVD1266 | IL-1B (seq. 3) | IL-17 (seq. 1) | 43 |
| DVD1267 | IL-17 (seq. 1) | IL-1B (seq. 3) | 37.8 |
| DVD1268 | IL-1B (seq. 4) | IL-17 (seq. 1) | 28.18 |
| DVD1269 | IL-17 (seq. 1) | IL-1B (seq. 4) | 32.74 |
| DVD1270 | IL-1B (seq. 5) | IL-17 (seq. 1) | 43.8 |
| DVD1271 | IL-17 (seq. 1) | IL-1B (seq. 5) | 36.6 |
| DVD1272 | IL-1B (seq. 1) | IL-17 (seq. 2) | 45.8 |
| DVD1273 | IL-17 (seq. 2) | IL-1B (seq. 1) | 31.4 |
| DVD1274 | IL-1B (seq. 2) | IL-17 (seq. 2) | 55.36 |
| DVD1275 | IL-17 (seq. 2) | IL-1B (seq. 2) | 34.52 |
| DVD1276 | IL-1B (seq. 3) | IL-17 (seq. 2) | 85.3 |
| DVD1277 | IL-17 (seq. 2) | IL-1B (seq. 3) | 73 |
| DVD1278 | IL-1B (seq. 4) | IL-17 (seq. 2) | 69.38 |
| DVD1279 | IL-17 (seq. 2) | IL-1B (seq. 4) | 57.62 |
| DVD1280 | IL-1B (seq. 5) | IL-17 (seq. 2) | 88.6 |
| DVD1281 | IL-17 (seq. 2) | IL-1B (seq. 5) | 65 |
| DVD1282 | IL-1B (seq. 1) | IL-17 (seq. 3) | 53.2 |
| DVD1283 | IL-17 (seq. 3) | IL-1B (seq. 1) | 65.8 |
| DVD1284 | IL-1B (seq. 2) | IL-17 (seq. 3) | 32.2 |
| DVD1285 | IL-17 (seq. 3) | IL-1B (seq. 2) | 30.2 |
| DVD1286 | IL-1B (seq. 3) | IL-17 (seq. 3) | 96.2 |
| DVD1287 | IL-17 (seq. 3) | IL-1B (seq. 3) | 83.6 |
| DVD1288 | IL-1B (seq. 4) | IL-17 (seq. 3) | 78.4 |
| DVD1289 | IL-17 (seq. 3) | IL-1B (seq. 4) | 5.36 |
| DVD1290 | IL-1B (seq. 5) | IL-17 (seq. 3) | 28.6 |
| DVD1291 | IL-17 (seq. 3) | IL-1B (seq. 5) | 49.6 |
| DVD1589 | IL-1B (seq. 1) | IL-17 (seq. 1) | 22.4 |
| DVD1590 | IL-17 (seq. 1) | IL-1B (seq. 1) | 3.86 |
| DVD1591 | IL-1B (seq. 2) | IL-17 (seq. 1) | 7.52 |
| DVD1592 | IL-17 (seq. 1) | IL-1B (seq. 2) | 0.54 |
| DVD1593 | IL-1B (seq. 3) | IL-17 (seq. 1) | 9.82 |
| DVD1594 | IL-17 (seq. 1) | IL-1B (seq. 3) | 35.38 |
| DVD1595 | IL-1B (seq. 4) | IL-17 (seq. 1) | 37.28 |
| DVD1596 | IL-17 (seq. 1) | IL-1B (seq. 4) | 35.8 |
| DVD1597 | IL-1B (seq. 5) | IL-17 (seq. 1) | 22.4 |
| DVD1598 | IL-17 (seq. 1) | IL-1B (seq. 5) | 29.22 |
| DVD1599 | IL-1B (seq. 1) | IL-17 (seq. 2) | 41.3 |
| DVD1600 | IL-17 (seq. 2) | IL-1B (seq. 1) | 10.58 |
| DVD1601 | IL-1B (seq. 2) | IL-17 (seq. 2) | 31.76 |
| DVD1602 | IL-17 (seq. 2) | IL-1B (seq. 2) | 10.7 |
| DVD1603 | IL-1B (seq. 3) | IL-17 (seq. 2) | 2.66 |
| DVD1604 | IL-17 (seq. 2) | IL-1B (seq. 3) | 6.54 |
| DVD1605 | IL-1B (seq. 4) | IL-17 (seq. 2) | 3.5 |
| DVD1606 | IL-17 (seq. 2) | IL-1B (seq. 4) | 1.28 |
| DVD1607 | IL-1B (seq. 5) | IL-17 (seq. 2) | 0.34 |
| DVD1608 | IL-17 (seq. 2) | IL-1B (seq. 5) | 0.82 |
| DVD1609 | IL-1B (seq. 1) | IL-17 (seq. 3) | 44.74 |
| DVD1610 | IL-17 (seq. 3) | IL-1B (seq. 1) | 21.5 |
| DVD1611 | IL-1B (seq. 2) | IL-17 (seq. 3) | 35.98 |
| DVD1612 | IL-17 (seq. 3) | IL-1B (seq. 2) | 13.98 |
| DVD1613 | IL-1B (seq. 3) | IL-17 (seq. 3) | 28.38 |
| DVD1614 | IL-17 (seq. 3) | IL-1B (seq. 3) | 25.78 |
| DVD1615 | IL-1B (seq. 4) | IL-17 (seq. 3) | 74.94 |
| DVD1616 | IL-17 (seq. 3) | IL-1B (seq. 4) | 51.34 |
| DVD1617 | IL-1B (seq. 5) | IL-17 (seq. 3) | 85.5 |
| DVD1618 | IL-17 (seq. 3) | IL-1B (seq. 5) | 45.92 |
| DVD1619 | IL-1B (seq. 1) | IL-17 (seq. 1) | 39.88 |
| DVD1620 | IL-17 (seq. 1) | IL-1B (seq. 1) | 23.2 |
| DVD1621 | IL-1B (seq. 2) | IL-17 (seq. 1) | 38.22 |
| DVD1622 | IL-17 (seq. 1) | IL-1B (seq. 2) | 15.54 |
| DVD1623 | IL-1B (seq. 3) | IL-17 (seq. 1) | 35.88 |
| DVD1624 | IL-17 (seq. 1) | IL-1B (seq. 3) | 37.38 |
| DVD1625 | IL-1B (seq. 4) | IL-17 (seq. 1) | 60.96 |
| DVD1626 | IL-17 (seq. 1) | IL-1B (seq. 4) | 66.38 |
| DVD1627 | IL-1B (seq. 5) | IL-17 (seq. 1) | 72.02 |
| DVD1628 | IL-17 (seq. 1) | IL-1B (seq. 5) | 52.2 |
| DVD1629 | IL-1B (seq. 1) | IL-17 (seq. 2) | 70.36 |
| DVD1630 | IL-17 (seq. 2) | IL-1B (seq. 1) | 58.84 |
| DVD1631 | IL-1B (seq. 2) | IL-17 (seq. 2) | 68.04 |
| DVD1632 | IL-17 (seq. 2) | IL-1B (seq. 2) | 55.08 |
| DVD1633 | IL-1B (seq. 3) | IL-17 (seq. 2) | 1 |
| DVD1634 | IL-17 (seq. 2) | IL-1B (seq. 3) | 0.9 |
| DVD1635 | IL-1B (seq. 4) | IL-17 (seq. 2) | 16.58 |
| DVD1636 | IL-17 (seq. 2) | IL-1B (seq. 4) | 6.52 |
| DVD1637 | IL-1B (seq. 5) | IL-17 (seq. 2) | 11.14 |
| DVD1638 | IL-17 (seq. 2) | IL-1B (seq. 5) | 2.24 |
| DVD1639 | IL-1B (seq. 1) | IL-17 (seq. 3) | 9.2 |
| DVD1640 | IL-17 (seq. 3) | IL-1B (seq. 1) | 4.84 |
| DVD1641 | IL-1B (seq. 2) | IL-17 (seq. 3) | 12.8 |
| DVD1642 | IL-17 (seq. 3) | IL-1B (seq. 2) | 26.48 |
| DVD1643 | IL-1B (seq. 3) | IL-17 (seq. 3) | 2.94 |
| DVD1644 | IL-17 (seq. 3) | IL-1B (seq. 3) | 32.68 |
| DVD1645 | IL-1B (seq. 4) | IL-17 (seq. 3) | 51.1 |
| DVD1646 | IL-17 (seq. 3) | IL-1B (seq. 4) | 32.68 |
| DVD1647 | IL-1B (seq. 5) | IL-17 (seq. 3) | 14.13 |
| DVD1648 | IL-17 (seq. 3) | IL-1B (seq. 5) | 5.12 |

All DVDs expressed well in 293 cells. DVDs could be easily purified over a protein A column. In most cases >5 mg/L purified DVD-Ig could be obtained easily from supernatants of 293 cells.

Example 1.4.5

Characterization and Lead Selection of A/B DVD-Igs

The binding affinities of anti-A/B DVD-Igs are analyzed on Biacore against both protein A and protein B. The tetravalent property of the DVD-Ig is examined by multiple binding studies on Biacore. Meanwhile, the neutralization potency of the DVD-Igs for protein A and protein B are assessed by bioassays, respectively, as described herein. The DVD-Ig molecules that best retain the affinity and potency of the original parent mAbs are selected for in-depth physicochemical and bio-analytical (rat PK) characterizations as described herein for each mAb. Based on the collection of analyses, the final lead DVD-Ig is advanced into CHO stable cell line development, and the CHO-derived material is employed in stability, pharmacokinetic and efficacy studies in cynomolgus monkey, and preformulation activities.

Example 2

Generation and Characterization of Dual Variable Domain Immunoglobulins (DVD-Ig)

Dual variable domain immunoglobulins (DVD-Ig) using parent antibodies with known amino acid sequences were generated by synthesizing polynucleotide fragments encoding DVD-Ig variable heavy and DVD-Ig variable light chain sequences and cloning the fragments into a pHybC-D2 vector according to Example 1.4.4.1. The DVD-Ig constructs were cloned into and expressed in 293 cells as described in Example 1, 4.4.2. The DVD-Ig protein was purified according to standard methods. Functional characteristics were determined according to the methods described in Example 1.1.1 and 1.1.2 as indicated. DVD-Ig VH and VL chains for the DVD-Igs are provided below.

Example 2.1

Generation of IL-1β (Seq. 1) and IL-17 (seq. 1)
DVD-Igs with Linker Set 1

TABLE 14

| SEQ ID NO | DVD Variable Domain Name | Outer Variable Domain Name | Inner Variable Domain Name | Sequence 123456789012345678901234567890123456789012345 |
|---|---|---|---|---|
| 50 | DVD1262H | AB268VH | AB273VH | EVQLVESGGGVVQPGRSLRLSCSASGFIFSRYDMSWVRQAPGKGLEWVAYISHGGAGTYYPDSVKGRFTISRDNSKNTLFLQMDSLRPEDTGVYFCARGGVTKGYFDVWGQGTPVTVSSASTKGPEVQLVQSGAEVKKPGSSVKVSCKASGYTFTDYEIHWVRQAPGQGLEWMGVNDPESGGTFYNQKFDGRVTLTADESTSTAYMELSSLRSEDTAVYYCTRYSKWDSFDGMDYWGQGTTVTVSS |
| 51 | DVD1262L | AB268VL | AB273VL | DIQMTQSPSSLSASVGDRVTITCRASGNIHNYLTWYQQTPGKAPKLLIYNAKTLADGVPSRFSGSGSGTDYTFTISSLQPEDIATYYCQHFWSIPYTFGQGTKLQITRTVAAPDIQMTQSPSSLSASVGDRVTITCRASSGIISYIDWFQQKPGKAPKRLIYATFDLASGVPSRFSGSGSGTDYTLTISSLQPEDFATYYCRQVGSYPETFGQGTKLEIKR |
| 52 | DVD1263H | AB273VH | AB268VH | EVQLVQSGAEVKKPGSSVKVSCKASGYTFTDYEIHWVRQAPGQGLEWMGVNDPESGGTFYNQKFDGRVTLTADESTSTAYMELSSLRSEDTAVYYCTRYSKWDSFDGMDYWGQGTTVTVSSASTKGPEVQLVESGGGVVQPGRSLRLSCSASGFIFSRYDMSWVRQAPGKGLEWVAYISHGGAGTYYPDSVKGRFTISRDNSKNTLFLQMDSLRPEDTGVYFCARGGVTKGYFDVWGQGTPVTVSS |
| 53 | DVD1263L | AB273VL | AB268VL | DIQMTQSPSSLSASVGDRVTITCRASSGIISYIDWFQQKPGKAPKRLIYATFDLASGVPSRFSGSGSGTDYTLTISSLQPEDFATYYCRQVGSYPETFGQGTKLEIKRTVAAPDIQMTQSPSSLSASVGDRVTITCRASGNIHNYLTWYQQTPGKAPKLLIYNAKTLADGVPSRFSGSGSGTDYTFTISSLQPEDIATYYCQHFWSIPYTFGQGTKLQITR |

Example 2.2

Generation of IL-1β (Seq. 2) and IL-17 (Seq. 1)
DVD-Igs with Linker Set 1

TABLE 15

| SEQ ID NO | DVD Variable Domain Name | Outer Variable Domain Name | Inner Variable Domain Name | Sequence 123456789012345678901234567890123456789012345 |
|---|---|---|---|---|
| 54 | DVD1264H | AB269VH | AB273VH | EVQLVESGGGVVQPGRSLRLSCSASGFIFSRYDMSWVRQAPGKGLEWVAYISHGGAGTYYPDSVKGRFTISRDNSKNTLFLQMDSLRAEDTAVYYCARGGVYKGYFDVWGQGTPVTVSSASTKGPEVQLVQSGAEVKKPGSSVKVSCKASGYTFTDYEIHWVRQAPGQGLEWMGVNDPESGGTFYNQKFDGRVTLTADESTSTAYMELSSLRSEDTAVYYCTRYSKWDSFDGMDYWGQGTTVTVSS |
| 55 | DVD1264L | AB269VL | AB273VL | DIQMTQSPSSLSASVGDRVTITCRASGNIHNYLTWYQQTPGKAPKLLIYNAKTLADGVPSRFSGSGSGTDYTFTISSLQPEDIATYYCQHFWSIPYTFGQGTKLQITRTVAAPDIQMTQSPSSLSASVGDRVTITCRASSGIISYIDWFQQKPGKAPKRLIYATFDLASGVPSR |

TABLE 15-continued

| SEQ ID NO | DVD Variable Domain Name | Outer Variable Domain Name | Inner Variable Domain Name | Sequence 123456789012345678901234567890123456789012345 |
|---|---|---|---|---|
| | | | | FSGSGSGTDYTLTISSLQPEDFATYYCRQVGSYPETFGQGTKLEIKR |
| 56 | DVD1265H | AB273VH | AB269VH | EVQLVQSGAEVKKPGSSVKVSCKASGYTFTDYEIHWVRQAPGQGLEWMGVNDPESGGTFYNQKFDGRVTLTADESTSTAYMELSSLRSEDTAVYYCTRYSKWDSFDGMDYWGQGTTVTVSSASTKGPEVQLVESGGGVVQPGRSLRLSCSASGFIFSRYDMSWVRQAPGKGLEWVAYISHGGAGTYYPDSVKGRFTISRDNSKNTLFLQMDSLRAEDTAVYYCARGGVYKGYFDVWGQGTPVTVSS |
| 57 | DVD1265L | AB273VL | AB269VL | DIQMTQSPSSLSASVGDRVTITCRASSGIISYIDWFQQKPGKAPKRLIYATFDLASGVPSRFSGSGSGTDYTLTISSLQPEDFATYYCRQVGSYPETFGQGTKLEIKRTVAAPDIQMTQSPSSLSASVGDRVTITCRASGNIHNYLTWYQQTPGKAPKLLIYNAKTLADGVPSRFSGSGSGTDYTFTISSLQPEDIATYYCQHFWSIPYTFGQGTKLQITR |

Example 2.3

Generation of IL-1β (Seq. 3) and IL-17 (Seq. 1) DVD-Igs with Linker Set 1

TABLE 16

| SEQ ID NO | DVD Variable Domain Name | Outer Variable Domain Name | Inner Variable Domain Name | Sequence 1234567890123456789012345678901234567 89012345 |
|---|---|---|---|---|
| 58 | DVD1266H | AB270VH | AB273VH | EVQLQESGPGLVKPSETLSLTCTVSGFSLSDYGVSWIRQPPGKGLEWLGLIWGGGDTYYNSPLKSRLTISKDNSKSQVSLKLSSVTAADTAVYYCAKQRTLWGYDLYGMDYWGQGTLVTVSSASTKGPEVQLVQSGAEVKKPGSSVKVSCKASGYTFTDYEIHWVRQAPGQGLEWMGVNDPESGGTFYNQKFDGRVTLTADESTSTAYMELSSLRSEDTAVYYCTRYSKWDSFDGMDYWGQGTTVTVSS |
| 59 | DVD1266L | AB270VL | AB273VL | DTQVTQSPSSLSASVGDRVTITCITSTDIDVDMNWYQQKPGKPPKLLISQGNTLRPGVPSRFSSSGSGTDFTFTISSLQPEDFATYYCLQSDNLPLTFGQGTKLEIKRTVAAPDIQMTQSPSSLSASVGDRVTITCRASSGIISYIDWFQQKPGKAPKRLIYATFDLASGVPSRFSGSGSGTDYTLTISSLQPEDFATYYCRQVGSYPETFGQGTKLEIKR |
| 60 | DVD1267H | AB273VH | AB270VH | EVQLVQSGAEVKKPGSSVKVSCKASGYTFTDYEIHWVRQAPGQGLEWMGVNDPESGGTFYNQKFDGRVTLTADESTSTAYMELSSLRSEDTAVYYCTRYSKWDSFDGMDYWGQGTTVTVSSASTKGPEVQLQESGPGLVKPSETLSLTCTVSGFSLSDYGVSWIRQPPGKGLEWLGLIWGGGDTYYNSPLKSRLTISKDNSKSQVSLKLSSVTAADTAVYYCAKQRTLWGYDLYGMDYWGQGTLVTVSS |
| 61 | DVD1267L | AB273VL | AB270VL | DIQMTQSPSSLSASVGDRVTITCRASSGIISYIDWFQQKPGKAPKRLIYATFDLASGVPSRFSGSGSGTDYTLTISSLQPEDFATYYCRQVGSYPETFGQGTKLEIKRTVAAPDTQVTQSPSSLSASVGDRVTITCITSTDIDVDMNWYQQKPGKPPKLLIS |

TABLE 16-continued

| SEQ ID NO | DVD Variable Domain Name | Outer Variable Domain Name | Inner Variable Domain Name | Sequence 12345678901234567890123456789012345 |
|---|---|---|---|---|
| | | | | QGNTLRPGVPSRFSSSGSGTDFTFTIS SLQPEDFATYYCLQSDNLPLTFGQGTK LEIKR |

Example 2.4

Generation of IL-1β (Seq. 4) and IL-17 (Seq. 1) DVD-Igs with Linker Set 1

TABLE 17

| SEQ ID NO | DVD Variable Domain Name | Outer Variable Domain Name | Inner Variable Domain Name | Sequence 1234567890123456789012345678 9012345 |
|---|---|---|---|---|
| 62 | DVD1268H | AB271VH | AB273VH | EVQLQESGPGLVKPSETLSLTCTVSGFSL SDYGVSWIRQPPGKGLEWLGLIWGGGDTY YNSPLKSRLTISKDNSKSQVSLKLSSVTA ADTAVYYCAKQRTLWGYDLYGMDYWGQGT LVTVSSASTKGPEVQLVQSGAEVKKPGSS VKVSCKASGYTFTDYEIHWVRQAPGQGLE WMGVNDPESGGTFYNQKFDGRVTLTADES TSTAYMELSSLRSEDTAVYYCTRYSKWDS FDGMDYWGQGTTVTVSS |
| 63 | DVD1268L | AB271VL | AB273VL | DTVVTQSPAFLSVTPGEKVTITCITSTDI DVDMNWYQQKPDQPPKLLISQGNTLRPGV PSRFSSSGSGTDFTFTISSLEAEDAATYY CLQSDNLPLTFGQGTKLEIKRTVAAPDIQ MTQSPSSLSASVGDRVTITCRASSGIISY IDWFQQKPGKAPKRLIYATFDLASGVPSR FSGSGSGTDYTLTISSLQPEDFATYYCRQ VGSYPETFGQGTKLEIKR |
| 64 | DVD1269H | AB273VH | AB271VH | EVQLVQSGAEVKKPGSSVKVSCKASGYTF TDYEIHWVRQAPGQGLEWMGVNDPESGGT FYNQKFDGRVTLTADESTSTAYMELSSLR SEDTAVYYCTRYSKWDSFDGMDYWGQGTT VTVSSASTKGPEVQLQESGPGLVKPSETL SLTCTVSGFSLSDYGVSWIRQPPGKGLEW LGLIWGGGDTYYNSPLKSRLTISKDNSKS QVSLKLSSVTAADTAVYYCAKQRTLWGYD LYGMDYWGQGTLVTVSS |
| 65 | DVD1269L | AB273VL | AB271VL | DIQMTQSPSSLSASVGDRVTITCRASSGI ISYIDWFQQKPGKAPKRLIYATFDLASGV PSRFSGSGSGTDYTLTISSLQPEDFATYY CRQVGSYPETFGQGTKLEIKRTVAAPDTV VTQSPAFLSVTPGEKVTITCITSTDIDVD MNWYQQKPDQPPKLLISQGNTLRPGVPSR FSSSGSGTDFTFTISSLEAEDAATYYCLQ SDNLPLTFGQGTKLEIKR |

Example 2.5

Generation of IL-1β (Seq. 5) and IL-17 (Seq. 1) DVD-Igs with Linker Set 1

TABLE 18

| SEQ ID NO | DVD Variable Domain Name | Outer Variable Domain Name | Inner Variable Domain Name | Sequence 123456789012345678901234567 89012345 |
|---|---|---|---|---|
| 66 | DVD1270H | AB272VH | AB273VH | EVQLVESGGGLVQPGGSLRLSCAVSGFT LSDYGVSWIRQAPGKGLEWLGLIWGGGD TYYNSPLKSRLTISKDNSKSTVYLQMNS LRAEDTAVYYCAKQRTLWGYDLYGMDYW |

TABLE 18-continued

| SEQ ID NO | DVD Variable Domain Name | Outer Variable Domain Name | Inner Variable Domain Name | Sequence 123456789012345678901234567890123456789012345 |
|---|---|---|---|---|
| | | | | GQGTLVTVSSASTKGPEVQLVQSGAEVK KPGSSVKVSCKASGYTFTDYEIHWVRQA PGQGLEWMGVNDPESGGTFYNQKFDGRV TLTADESTSTAYMELSSLRSEDTAVYYC TRYSKWDSFDGMDYWGQGTTVTVSS |
| 67 | DVD1270L | AB272VL | AB273VL | ETTVTQSPSSLSASVGDRVTITCITSTD IDVDMNWYQQKPGKPPKLLISQGNTLRP GVPSRFSSSGSGTDFTFTISSLQPEDFA TYYCLQSDNLPLTFGQGTKLEIKRTVAA PDIQMTQSPSSLSASVGDRVTITCRASS GIISYIDWFQQKPGKAPKRLIYATFDLA SGVPSRFSGSGSGTDYTLTISSLQPEDF ATYYCRQVGSYPETFGQGTKLEIKR |
| 68 | DVD1271H | AB273VH | AB272VH | EVQLVQSGAEVKKPGSSVKVSCKASGYT FTDYEIHWVRQAPGQGLEWMGVNDPESG GTFYNQKFDGRVTLTADESTSTAYMELS SLRSEDTAVYYCTRYSKWDSFDGMDYWG QGTTVTVSSASTKGPEVQLVESGGGLVQ PGGSLRLSCAVSGFTLSDYGVSWIRQAP GKGLEWLGLIWGGDTYYNSPLKSRLTI SKDNSKSTVYLQMNSLRAEDTAVYYCAK QRTLWGYDLYGMDYWGQGTLVTVSS |
| 69 | DVD1271L | AB273VL | AB272VL | DIQMTQSPSSLSASVGDRVTITCRASSG IISYIDWFQQKPGKAPKRLIYATFDLAS GVPSRFSGSGSGTDYTLTISSLQPEDFA TYYCRQVGSYPETFGQGTKLEIKRTVAA PETTVTQSPSSLSASVGDRVTITCITST DIDVDMNWYQQKPGKPPKLLISQGNTLR PGVPSRFSSSGSGTDFTFTISSLQPEDF ATYYCLQSDNLPLTFGQGTKLEIKR |

Example 2.6

Generation of IL-1β (Seq. 1) and IL-17 (Seq. 2) DVD-Igs with Linker Set 1

TABLE 19

| SEQ ID NO | DVD Variable Domain Name | Outer Variable Domain Name | Inner Variable Domain Name | Sequence 123456789012345678901234567890123456789012345 |
|---|---|---|---|---|
| 70 | DVD1272H | AB268VH | AB274VH | EVQLVESGGGVVQPGRSLRLSCSASGFI FSRYDMSWVRQAPGKGLEWVAYISHGGA GTYYPDSVKGRFTISRDNSKNTLFLQMD SLRPEDTGVYFCARGGVTKGYFDVWGQG TPVTVSSASTKGPEVQLVQSGAEVKKPG SSVKVSCKASGGSFGGYGIGWVRQAPGQ GLEWMGGITPFFGFADYAQKFQGRVTIT ADESTTTAYMELSGLTSDDTAVYYCARD PNEFWNGYYSTHDFDSWGQGTTVTVSS |
| 71 | DVD1272L | AB268VL | AB274VL | DIQMTQSPSSLSASVGDRVTITCRASGN IHNYLTWYQQTPGKAPKLLIYNAKTLAD GVPSRFSGSGSGTDYTFTISSLQPEDIA TYYCQHFWSIPYTFGQGTKLQITRTVAA PEIVLTQSPDFQSVTPKEKVTITCRASQ DIGSELHWYQQKPDQPPKLLIKYASHST SGVPSRFSGSGSGTDFTLTINGLEAEDA GTYYCHQTDSLPYTFGPGTKVDIKR |
| 72 | DVD1273H | AB274VH | AB268VH | EVQLVQSGAEVKKPGSSVKVSCKASGGS FGGYGIGWVRQAPGQGLEWMGGITPFFG FADYAQKFQGRVTITADESTTTAYMELS GLTSDDTAVYYCARDPNEFWNGYYSTHD FDSWGQGTTVTVSSASTKGPEVQLVESG GGVVQPGRSLRLSCSASGFIFSRYDMSW VRQAPGKGLEWVAYISHGGAGTYYPDSV |

TABLE 19-continued

| SEQ ID NO | DVD Variable Domain Name | Outer Variable Domain Name | Inner Variable Domain Name | Sequence 123456789012345678 9012345 |
|---|---|---|---|---|
| | | | | KGRFTISRDNSKNTLFLQMDSLRPEDTG VYFCARGGVTKGYFDVWGQGTPVTVSS |
| 73 | DVD1273L | AB274VL | AB268VL | EIVLTQSPDFQSVTPKEKVTITCRASQD IGSELHWYQQKPDQPPKLLIKYASHSTS GVPSRFSGSGSGTDFTLTINGLEAEDAG TYYCHQTDSLPYTFGPGTKVDIKRTVAA PDIQMTQSPSSLSASVGDRVTITCRASG NIHNYLTWYQQTPGKAPKLLIYNAKTLA DGVPSRFSGSGSGTDYTFTISSLQPEDI ATYYCQHFWSIPYTFGQGTKLQITR |

Example 2.7

Generation of IL-1β (Seq. 2) and IL-17 (Seq. 2) DVD-Igs with Linker Set 1

TABLE 20

| SEQ ID NO | DVD Variable Domain Name | Outer Variable Domain Name | Inner Variable Domain Name | Sequence 123456789012345678 9012345 |
|---|---|---|---|---|
| 74 | DVD1274H | AB269VH | AB274VH | EVQLVESGGGVVQPGRSLRLSCSASGFI FSRYDMSWVRQAPGKGLEWVAYISHGGA GTYYPDSVKGRFTISRDNSKNTLFLQMD SLRAEDTAVYYCARGGVYKGYFDVWGQG TPVTVSSASTKGPEVQLVQSGAEVKKPG SSVKVSCKASGGSFGGYGIGWVRQAPGQ GLEWMGGITPFFGFADYAQKFQGRVTIT ADESTTTAYMELSGLTSDDTAVYYCARD PNEFWNGYYSTHDFDSWGQGTTVTVSS |
| 75 | DVD1274L | AB269VL | AB274VL | DIQMTQSPSSLSASVGDRVTITCRASGN IHNYLTWYQQTPGKAPKLLIYNAKTLAD GVPSRFSGSGSGTDYTFTISSLQPEDIA TYYCQHFWSIPYTFGQGTKLQITRTVAA PEIVLTQSPDFQSVTPKEKVTITCRASQ DIGSELHWYQQKPDQPPKLLIKYASHST SGVPSRFSGSGSGTDFTLTINGLEAEDA GTYYCHQTDSLPYTFGPGTKVDIKR |
| 76 | DVD1275H | AB274VH | AB269VH | EVQLVQSGAEVKKPGSSVKVSCKASGGS FGGYGIGWVRQAPGQGLEWMGGITPFFG FADYAQKFQGRVTITADESTTTAYMELS GLTSDDTAVYYCARDPNEFWNGYYSTHD FDSWGQGTTVTVSSASTKGPEVQLVESG GGVVQPGRSLRLSCSASGFIFSRYDMSW VRQAPGKGLEWVAYISHGGAGTYYPDSV KGRFTISRDNSKNTLFLQMDSLRAEDTA VYYCARGGVYKGYFDVWGQGTPVTVSS |
| 77 | DVD1275L | AB274VL | AB269VL | EIVLTQSPDFQSVTPKEKVTITCRASQD IGSELHWYQQKPDQPPKLLIKYASHSTS GVPSRFSGSGSGTDFTLTINGLEAEDAG TYYCHQTDSLPYTFGPGTKVDIKRTVAA PDIQMTQSPSSLSASVGDRVTITCRASG NIHNYLTWYQQTPGKAPKLLIYNAKTLA DGVPSRFSGSGSGTDYTFTISSLQPEDI ATYYCQHFWSIPYTFGQGTKLQITR |

Example 2.8

Generation of IL-1β (Seq. 3) and IL-17 (Seq. 2) DVD-Igs with Linker Set 1

TABLE 21

| SEQ ID NO | DVD Variable Domain Name | Outer Variable Domain Name | Inner Variable Domain Name | Sequence 123456789012345678901234567890123456789012345 |
|---|---|---|---|---|
| 78 | DVD1276H | AB270VH | AB274VH | EVQLQESGPGLVKPSETLSLTCTVSGFSLSDYGVSWIRQPPGKGLEWLGLIWGGGDTYYNSPLKSRLTISKDNSKSQVSLKLSSVTAADTAVYYCAKQRTLWGYDLYGMDYWGQGTLVTVSSASTKGPEVQLVQSGAEVKKPGSSVKVSCKASGGSFGGYGIGWVRQAPGQGLEWMGGITPFFGFADYAQKFQGRVTITADESTTTAYMELSGLTSDDTAVYYCARDPNEFWNGYYSTHDFDSWGQGTTVTVSS |
| 79 | DVD1276L | AB270VL | AB274VL | DTQVTQSPSSLSASVGDRVTITCITSTDIDVDMNWYQQKPGKPPKLLISQGNTLRPGVPSRFSSSGSGTDFTFTISSLQPEDFATYYCLQSDNLPLTFGQGTKLEIKRTVAAPEIVLTQSPDFQSVTPKEKVTITCRASQDIGSELHWYQQKPDQPPKLLIKYASHSTSGVPSRFSGSGSGTDFTLTINGLEAEDAGTYYCHQTDSLPYTFGPGTKVDIKR |
| 80 | DVD1277H | AB274VH | AB270VH | EVQLVQSGAEVKKPGSSVKVSCKASGGSFGGYGIGWVRQAPGQGLEWMGGITPFFGFADYAQKFQGRVTITADESTTTAYMELSGLTSDDTAVYYCARDPNEFWNGYYSTHDFDSWGQGTTVTVSSASTKGPEVQLQESGPGLVKPSETLSLTCTVSGFSLSDYGVSWIRQPPGKGLEWLGLIWGGGDTYYNSPLKSRLTISKDNSKSQVSLKLSSVTAADTAVYYCAKQRTLWGYDLYGMDYWGQGTLVTVSS |
| 81 | DVD1277L | AB274VL | AB270VL | EIVLTQSPDFQSVTPKEKVTITCRASQDIGSELHWYQQKPDQPPKLLIKYASHSTSGVPSRFSGSGSGTDFTLTINGLEAEDAGTYYCHQTDSLPYTFGPGTKVDIKRTVAAPDTQVTQSPSSLSASVGDRVTITCITSTDIDVDMNWYQQKPGKPPKLLISQGNTLRPGVPSRFSSSGSGTDFTFTISSLQPEDFATYYCLQSDNLPLTFGQGTKLEIKR |

Example 2.9

Generation of IL-1β (Seq. 4) and IL-17 (Seq. 2) DVD-Igs with Linker Set 1

TABLE 22

| SEQ ID NO | DVD Variable Domain Name | Outer Variable Domain Name | Inner Variable Domain Name | Sequence 123456789012345678901234567890123456789012345 |
|---|---|---|---|---|
| 82 | DVD1278H | AB271VH | AB274VH | EVQLQESGPGLVKPSETLSLTCTVSGFSLSDYGVSWIRQPPGKGLEWLGLIWGGGDTYYNSPLKSRLTISKDNSKSQVSLKLSSVTAADTAVYYCAKQRTLWGYDLYGMDYWGQGTLVTVSSASTKGPEVQLVQSGAEVKKPGSSVKVSCKASGGSFGGYGIGWVRQAPGQGLEWMGGITPFFGFADYAQKFQGRVTITADESTTTAYMELSGLTSDDTAVYYCARDPNEFWNGYYSTHDFDSWGQGTTVTVSS |
| 83 | DVD1278L | AB271VL | AB274VL | DTVVTQSPAFLSVTPGEKVTITCITSTDIDVDMNWYQQKPDQPPKLLISQGNTLRPGVPSRFSSSGSGTDFTFTISSLEAEDAATYYCLQSDNLPLTFGQGTKLEIKRTVAA |

TABLE 22-continued

| SEQ ID NO | DVD Variable Domain Name | Outer Variable Domain Name | Inner Variable Domain Name | Sequence 123456789012345678901234567890123456789012345 |
|---|---|---|---|---|
| | | | | PEIVLTQSPDFQSVTPKEKVTITCRASQ DIGSELHWYQQKPDQPPKLLIKYASHST SGVPSRFSGSGSGTDFTLTINGLEAEDA GTYYCHQTDSLPYTFGPGTKVDIKR |
| 84 | DVD1279H | AB274VH | AB271VH | EVQLVQSGAEVKKPGSSVKVSCKASGGS FGGYGIGWVRQAPGQGLEWMGGITPFFG FADYAQKFQGRVTITADESTTTAYMELS GLTSDDTAVYYCARDPNEFWNGYYSTHD FDSWGQGTTVTVSSASTKGPEVQLQESG PGLVKPSETLSLTCTVSGFSLSDYGVSW IRQPPGKGLEWLGLIWGGGDTYYNSPLK SRLTISKDNSKSQVSLKLSSVTAADTAV YYCAKQRTLWGYDLYGMDYWGQGTLVTV SS |
| 85 | DVD1279L | AB274VL | AB271VL | EIVLTQSPDFQSVTPKEKVTITCRASQD IGSELHWYQQKPDQPPKLLIKYASHSTS GVPSRFSGSGSGTDFTLTINGLEAEDAG TYYCHQTDSLPYTFGPGTKVDIKRTVAA PDTVVTQSPAFLSVTPGEKVTITCITST DIDVDMNWYQQKPDQPPKLLISQGNTLR PGVPSRFSSSGSGTDFTFTISSLEAEDA ATYYCLQSDNLPLTFGQGTKLEIKR |

Example 2.10

Generation of IL-1β (Seq. 5) and IL-17 (Seq. 2) DVD-Igs with Linker Set 1

TABLE 23

| SEQ ID NO | DVD Variable Domain Name | Outer Variable Domain Name | Inner Variable Domain Name | Sequence 123456789012345678901234567890123456789012345 |
|---|---|---|---|---|
| 86 | DVD1280H | AB272VH | AB274VH | EVQLVESGGGLVQPGGSLRLSCAVSGFT LSDYGVSWIRQAPGKGLEWLGLIWGGGD TYYNSPLKSRLTISKDNSKSTVYLQMNS LRAEDTAVYYCAKQRTLWGYDLYGMDYW GQGTLVTVSSASTKGPEVQLVQSGAEVK KPGSSVKVSCKASGGSFGGYGIGWVRQA PGQGLEWMGGITPFFGFADYAQKFQGRV TITADESTTTAYMELSGLTSDDTAVYYC ARDPNEFWNGYYSTHDFDSWGQGTTVTV SS |
| 87 | DVD1280L | AB272VL | AB274VL | ETTVTQSPSSLSASVGDRVTITCITSTD IDVDMNWYQQKPGKPPKLLISQGNTLRP GVPSRFSSSGSGTDFTFTISSLQPEDFA TYYCLQSDNLPLTFGQGTKLEIKRTVAA PEIVLTQSPDFQSVTPKEKVTITCRASQ DIGSELHWYQQKPDQPPKLLIKYASHST SGVPSRFSGSGSGTDFTLTINGLEAEDA GTYYCHQTDSLPYTFGPGTKVDIKR |
| 88 | DVD1281H | AB274VH | AB272VH | EVQLVQSGAEVKKPGSSVKVSCKASGGS FGGYGIGWVRQAPGQGLEWMGGITPFFG FADYAQKFQGRVTITADESTTTAYMELS GLTSDDTAVYYCARDPNEFWNGYYSTHD FDSWGQGTTVTVSSASTKGPEVQLVESG GGLVQPGGSLRLSCAVSGFTLSDYGVSW IRQAPGKGLEWLGLIWGGGDTYYNSPLK SRLTISKDNSKSTVYLQMNSLRAEDTAV YYCAKQRTLWGYDLYGMDYWGQGTLVTV SS |
| 89 | DVD1281L | AB274VL | AB272VL | EIVLTQSPDFQSVTPKEKVTITCRASQD IGSELHWYQQKPDQPPKLLIKYASHSTS GVPSRFSGSGSGTDFTLTINGLEAEDAG TYYCHQTDSLPYTFGPGTKVDIKRTVAA |

TABLE 23-continued

| SEQ ID NO | DVD Variable Domain Name | Outer Variable Domain Name | Inner Variable Domain Name | Sequence 123456789012345678901234567890123456789012345 |
|---|---|---|---|---|
| | | | | PETTVTQSPSSLSASVGDRVTITCITST DIDVDMNWYQQKPGKPPKLLISQGNTLR PGVPSRFSSSGSGTDFTFTISSLQPEDF ATYYCLQSDNLPLTFGQGTKLEIKR |

Example 2.11

Generation of IL-1β (Seq. 1) and IL-17 (Seq. 3) DVD-Igs with Linker Set 1

TABLE 24

| SEQ ID NO | DVD Variable Domain Name | Outer Variable Domain Name | Inner Variable Domain Name | Sequence 123456789012345678901234567890123456789012345 |
|---|---|---|---|---|
| 90 | DVD1282H | AB268VH | AB275VH | EVQLVESGGGVVQPGRSLRLSCSASGFI FSRYDMSWVRQAPGKGLEWVAYISHGGA GTYYPDSVKGRFTISRDNSKNTLFLQMD SLRPEDTGVYFCARGGVTKGYFDVWGQG TPVTVSSASTKGPEVQLVQSGAEVKKPG ESVKISCKASGGSFRSYGISWVRQAPGQ GLEWMGGITHFFGITDYAQKFQGRVTIT ADESTTTAYMELSGLTSDDTAVYYCARE PNDFWNGYYDTHDFDSWGQGTTVTVSS |
| 91 | DVD1282L | AB268VL | AB275VL | DIQMTQSPSSLSASVGDRVTITCRASGN IHNYLTWYQQTPGKAPKLLIYNAKTLAD GVPSRFSGSGSGTDYTFTISSLQPEDIA TYYCQHFWSIPYTFGQGTKLQITRTVAA PEIVLTQSPDFQSVTPKEKVTITCRASQ NIGSELHWYQQKPDQSPKLLIKYASHSI SGVPSRFSGSGSGTDFTLTINGLEAEDA ATYYCHQSDTLPHTFGQGTKVDIKR |
| 92 | DVD1283H | AB275VH | AB268VH | EVQLVQSGAEVKKPGESVKISCKASGGS FRSYGISWVRQAPGQGLEWMGGITHFFG ITDYAQKFQGRVTITADESTTTAYMELS GLTSDDTAVYYCAREPNDFWNGYYDTHD FDSWGQGTTVTVSSASTKGPEVQLVESG GGVVQPGRSLRLSCSASGFIFSRYDMSW VRQAPGKGLEWVAYISHGGAGTYYPDSV KGRFTISRDNSKNTLFLQMDSLRPEDTG VYFCARGGVTKGYFDVWGQGTPVTVSS |
| 93 | DVD1283L | AB275VL | AB268VL | EIVLTQSPDFQSVTPKEKVTITCRASQN IGSELHWYQQKPDQSPKLLIKYASHSIS GVPSRFSGSGSGTDFTLTINGLEAEDAA TYYCHQSDTLPHTFGQGTKVDIKRTVAA PDIQMTQSPSSLSASVGDRVTITCRASG NIHNYLTWYQQTPGKAPKLLIYNAKTLA DGVPSRFSGSGSGTDYTFTISSLQPEDI ATYYCQHFWSIPYTFGQGTKLQITR |

Example 2.12

Generation of IL-1β (Seq. 2) and IL-17 (Seq. 3) DVD-Igs with Linker Set 1

TABLE 25

| SEQ ID NO | DVD Variable Domain Name | Outer Variable Domain Name | Inner Variable Domain Name | Sequence 123456789012345678901234567890123456789012345 |
|---|---|---|---|---|
| 94 | DVD1284H | AB269VH | AB275VH | EVQLVESGGGVVQPGRSLRLSCSASGFI FSRYDMSWVRQAPGKGLEWVAYISHGGA GTYYPDSVKGRFTISRDNSKNTLFLQMD |

TABLE 25-continued

| SEQ ID NO | DVD Variable Domain Name | Outer Variable Domain Name | Inner Variable Domain Name | Sequence 123456789012345678901234567890123456789012345 |
|---|---|---|---|---|
|  |  |  |  | SLRAEDTAVYYCARGGVYKGYFDVWGQGTPVTVSSASTKGPEVQLVQSGAEVKKPGESVKISCKASGGSFRSYGISWVRQAPGQGLEWMGGITHFFGITDYAQKFQGRVTITADESTTTAYMELSGLTSDDTAVYYCAREPNDFWNGYYDTHDFDSWGQGTTVTVSS |
| 95 | DVD1284L | AB269VL | AB275VL | DIQMTQSPSSLSASVGDRVTITCRASGNIHNYLTWYQQTPGKAPKLLIYNAKTLADGVPSRFSGSGSGTDYTFTISSLQPEDIATYYCQHFWSIPYTFGQGTKLQITRTVAAPEIVLTQSPDFQSVTPKEKVTITCRASQNIGSELHWYQQKPDQSPKLLIKYASHSISGVPSRFSGSGSGTDFTLTINGLEAEDAATYYCHQSDTLPHTFGQGTKVDIKR |
| 96 | DVD1285H | AB275VH | AB269VH | EVQLVQSGAEVKKPGESVKISCKASGGSFRSYGISWVRQAPGQGLEWMGGITHFFGITDYAQKFQGRVTITADESTTTAYMELSGLTSDDTAVYYCAREPNDFWNGYYDTHDFDSWGQGTTVTVSSASTKGPEVQLVESGGGVVQPGRSLRLSCSASGFIFSRYDMSWVRQAPGKGLEWVAYISHGGAGTYYPDSVKGRFTISRDNSKNTLFLQMDSLRAEDTAVYYCARGGVYKGYFDVWGQGTPVTVSS |
| 97 | DVD1285L | AB275VL | AB269VL | EIVLTQSPDFQSVTPKEKVTITCRASQNIGSELHWYQQKPDQSPKLLIKYASHSISGVPSRFSGSGSGTDFTLTINGLEAEDAATYYCHQSDTLPHTFGQGTKVDIKRTVAAPDIQMTQSPSSLSASVGDRVTITCRASGNIHNYLTWYQQTPGKAPKLLIYNAKTLADGVPSRFSGSGSGTDYTFTISSLQPEDIATYYCQHFWSIPYTFGQGTKLQITR |

Example 2.13

Generation of IL-1β (Seq. 3) and IL-17 (Seq. 3) DVD-Igs with Linker Set 1

TABLE 26

| SEQ ID NO | DVD Variable Domain Name | Outer Variable Domain Name | Inner Variable Domain Name | Sequence 123456789012345678901234567890123456789012345 |
|---|---|---|---|---|
| 98 | DVD1286H | AB270VH | AB275VH | EVQLQESGPGLVKPSETLSLTCTVSGFSLSDYGVSWIRQPPGKGLEWLGLIWGGGDTYYNSPLKSRLTISKDNSKSQVSLKLSSVTAADTAVYYCAKQRTLWGYDLYGMDYWGQGTLVTVSSASTKGPEVQLVQSGAEVKKPGESVKISCKASGGSFRSYGISWVRQAPGQGLEWMGGITHFFGITDYAQKFQGRVTITADESTTTAYMELSGLTSDDTAVYYCAREPNDFWNGYYDTHDFDSWGQGTTVTVSS |
| 99 | DVD1286L | AB270VL | AB275VL | DTQVTQSPSSLSASVGDRVTITCITSTDIDVDMNWYQQKPGKPPKLLISQGNTLRPGVPSRFSSSGSGTDFTFTISSLQPEDFATYYCLQSDNLPLTFGQGTKLEIKRTVAAPEIVLTQSPDFQSVTPKEKVTITCRASQNIGSELHWYQQKPDQSPKLLIKYASHSISGVPSRFSGSGSGTDFTLTINGLEAEDAATYYCHQSDTLPHTFGQGTKVDIKR |
| 100 | DVD1287H | AB275VH | AB270VH | EVQLVQSGAEVKKPGESVKISCKASGGSFRSYGISWVRQAPGQGLEWMGGITHFFGITDYAQKFQGRVTITADESTTTAYMELSGLTSDDTAVYYCAREPNDFWNGYYDTHDFDSWGQGTTVTVSSASTKGPEVQLQESG |

TABLE 26-continued

| SEQ ID NO | DVD Variable Domain Name | Outer Variable Domain Name | Inner Variable Domain Name | Sequence 123456789012345678901234567890123456789012345 |
|---|---|---|---|---|
|  |  |  |  | PGLVKPSETLSLTCTVSGFSLSDYGVSW IRQPPGKGLEWLGLIWGGGDTYYNSPLK SRLTISKDNSKQVSLKLSSVTAADTAV YYCAKQRTLWGYDLYGMDYWGQGTLVTV SS |
| 101 | DVD1287L | AB275VL | AB270VL | EIVLTQSPDFQSVTPKEKVTITCRASQN IGSELHWYQQKPDQSPKLLIKYASHSIS GVPSRFSGSGSGTDFTLTINGLEAEDAA TYYCHQSDTLPHTFGQGTKVDIKRTVAA PDTQVTQSPSSLSASVGDRVTITCITST DIDVDMNWYQQKPGKPPKLLISQGNTLR PGVPSRFSSSGSGTDFTFTISSLQPEDF ATYYCLQSDNLPLTFGQGTKLEIKR |

Example 2.14

Generation of IL-1β (Seq. 4) and IL-17 (Seq. 3) DVD-Igs with Linker Set 1

TABLE 27

| SEQ ID NO | DVD Variable Domain Name | Outer Variable Domain Name | Inner Variable Domain Name | Sequence 123456789012345678901234567890123456789012345 |
|---|---|---|---|---|
| 102 | DVD1288H | AB271VH | AB275VH | EVQLQESGPGLVKPSETLSLTCTVSGFS LSDYGVSWIRQPPGKGLEWLGLIWGGGD TYYNSPLKSRLTISKDNSKQVSLKLSS VTAADTAVYYCAKQRTLWGYDLYGMDYW GQGTLVTVSSASTKGPEVQLVQSGAEVK KPGESVKISCKASGGSFRSYGISWVRQA PGQGLEWMGGITHFFGITDYAQKFQGRV TITADESTTTAYMELSGLTSDDTAVYYC AREPNDFWNGYYDTHDFDSWGQGTTVTV SS |
| 103 | DVD1288L | AB271VL | AB275VL | DTVVTQSPAFLSVTPGEKVTITCITSTD IDVDMNWYQQKPDQPPKLLISQGNTLRP GVPSRFSSSGSGTDFTFTISSLEAEDAA TYYCLQSDNLPLTFGQGTKLEIKRTVAA PEIVLTQSPDFQSVTPKEKVTITCRASQ NIGSELHWYQQKPDQSPKLLIKYASHSI SGVPSRFSGSGSGTDFTLTINGLEAEDA ATYYCHQSDTLPHTFGQGTKVDIKR |
| 104 | DVD1289H | AB275VH | AB271VH | EVQLVQSGAEVKKPGESVKISCKASGGS FRSYGISWVRQAPGQGLEWMGGITHFFG ITDYAQKFQGRVTITADESTTTAYMELS GLTSDDTAVYYCAREPNDFWNGYYDTHD FDSWGQGTTVTVSSASTKGPEVQLQESG PGLVKPSETLSLTCTVSGFSLSDYGVSW IRQPPGKGLEWLGLIWGGGDTYYNSPLK SRLTISKDNSKQVSLKLSSVTAADTAV YYCAKQRTLWGYDLYGMDYWGQGTLVTV SS |
| 105 | DVD1289L | AB275VL | AB271VL | EIVLTQSPDFQSVTPKEKVTITCRASQN IGSELHWYQQKPDQSPKLLIKYASHSIS GVPSRFSGSGSGTDFTLTINGLEAEDAA TYYCHQSDTLPHTFGQGTKVDIKRTVAA PDTVVTQSPAFLSVTPGEKVTITCITST DIDVDMNWYQQKPDQPPKLLISQGNTLR PGVPSRFSSSGSGTDFTFTISSLEAEDA ATYYCLQSDNLPLTFGQGTKLEIKR |

Example 2.15

Generation of IL-1β (Seq. 5) and IL-17 (seq. 3) DVD-Igs With Linker Set 1

TABLE 28

| SEQ ID NO | DVD Variable Domain Name | Outer Variable Domain Name | Inner Variable Domain Name | Sequence 123456789012345678901234567890123456789012345 |
|---|---|---|---|---|
| 106 | DVD1290H | AB272VH | AB275VH | EVQLVESGGGLVQPGGSLRLSCAVSGFTLSDYGVSWIRQAPGKGLEWLGLIWGGGDTYYNSPLKSRLTISKDNSKTVYLQMNSLRAEDTAVYYCAKQRTLWGYDLYGMDYWGQGTLVTVSSASTKGPEVQLVQSGAEVKKPGESVKISCKASGGSFRSYGISWVRQAPGQGLEWMGGITHFFGITDYAQKFQGRVTITADESTTTAYMELSGLTSDDTAVYYCAREPNDFWNGYYDTHDFDSWGQGTTVTVSS |
| 107 | DVD1290L | AB272VL | AB275VL | ETTVTQSPSSLSASVGDRVTITCITSTDIDVDMNWYQQKPGKPPKLLISQGNTLRPGVPSRFSSSGSGTDFTFTISSLQPEDFATYYCLQSDNLPLTFGQGTKLEIKRTVAAPEIVLTQSPDFQSVTPKEKVTITCRASQNIGSELHWYQQKPDQSPKLLIKYASHSISGVPSRFSGSGSGTDFTLTINGLEAEDAATYYCHQSDTLPHTFGQGTKVDIKR |
| 108 | DVD1291H | AB275VH | AB272VH | EVQLVQSGAEVKKPGESVKISCKASGGSFRSYGISWVRQAPGQGLEWMGGITHFFGITDYAQKFQGRVTITADESTTTAYMELSGLTSDDTAVYYCAREPNDFWNGYYDTHDFDSWGQGTTVTVSSASTKGPEVQLVESGGGLVQPGGSLRLSCAVSGFTLSDYGVSWIRQAPGKGLEWLGLIWGGGDTYYNSPLKSRLTISKDNSKTVYLQMNSLRAEDTAVYYCAKQRTLWGYDLYGMDYWGQGTLVTVSS |
| 109 | DVD1291L | AB275VL | AB272VL | EIVLTQSPDFQSVTPKEKVTITCRASQNIGSELHWYQQKPDQSPKLLIKYASHSISGVPSRFSGSGSGTDFTLTINGLEAEDAATYYCHQSDTLPHTFGQGTKVDIKRTVAAPETTVTQSPSSLSASVGDRVTITCITSTDIDVDMNWYQQKPGKPPKLLISQGNTLRPGVPSRFSSSGSGTDFTFTISSLQPEDFATYYCLQSDNLPLTFGQGTKLEIKR |

Example 2.16

Generation of IL-1β (Seq. 1) and IL-17 (Seq. 1) DVD-Igs with Linker Set 2

TABLE 29

| SEQ ID NO | DVD Variable Domain Name | Outer Variable Domain Name | Inner Variable Domain Name | Sequence 123456789012345678901234567890123456789012345 |
|---|---|---|---|---|
| 110 | DVD1589H | AB268VH | AB273VH | EVQLVESGGGVVQPGRSLRLSCSASGFIFSRYDMSWVRQAPGKGLEWVAYISHGGAGTYYPDSVKGRFTISRDNSKNTLFLQMDSLRPEDTGVYFCARGGVTKGYFDVWGQGTPVTVSSASTKGPEVQLVQSGAEVKKPGSSVKVSCKASGYTFTDYEIHWVRQAPGQGLEWMGVNDPESGGTFYNQKFDGRVTLTADESTSTAYMELSSLRSEDTAVYYCTRYSKWDSFDGMDYWGQGTTVTVSS |
| 111 | DVD1589L | AB268VL | AB273VL | DIQMTQSPSSLSASVGDRVTITCRASGNIHNYLTWYQQTPGKAPKLLIYNAKTLADGVPSRFSGSGSGTDYTFTISSLQPEDIATYYCQHFWSIPYTFGQGTKLQITRTVAAPSVFIFPPDIQMTQSPSSLSASVGDRVT |

TABLE 29-continued

| SEQ ID NO | DVD Variable Domain Name | Outer Variable Domain Name | Inner Variable Domain Name | Sequence 123456789012345678901234567890123456789012345 |
|---|---|---|---|---|
| | | | | ITCRASSGIISYIDWFQQKPGKAPKRLI YATFDLASGVPSRFSGSGSGTDYTLTIS SLQPEDFATYYCRQVGSYPETFGQGTKL EIKR |
| 112 | DVD1590H | AB273VH | AB268VH | EVQLVQSGAEVKKPGSSVKVSCKASGYT FTDYEIHWVRQAPGQGLEWMGVNDPESG GTFYNQKFDGRVTLTADESTSTAYMELS SLRSEDTAVYYCTRYSKWDSFDGMDYWG QGTTVTVSSASTKGPEVQLVESGGGVVQ PGRSLRLSCSASGFIFSRYDMSWVRQAP GKGLEWVAYISHGGAGTYYPDSVKGRFT ISRDNSKNTLFLQMDSLRPEDTGVYFCA RGGVTKGYFDVWGQGTPVTVSS |
| 113 | DVD1590L | AB273VL | AB268VL | DIQMTQSPSSLSASVGDRVTITCRASSG IISYIDWFQQKPGKAPKRLIYATFDLAS GVPSRFSGSGSGTDYTLTISSLQPEDFA TYYCRQVGSYPETFGQGTKLEIKRTVAA PSVFIFPPDIQMTQSPSSLSASVGDRVT ITCRASGNIHNYLTWYQQTPGKAPKLLI YNAKTLADGVPSRFSGSGSGTDYTFTIS SLQPEDIATYYCQHFWSIPYTFGQGTKL QITR |

Example 2.17

Generation of IL-1β (Seq. 2) and IL-17 (Seq. 1) DVD-Igs with Linker Set 2

TABLE 30

| SEQ ID NO | DVD Variable Domain Name | Outer Variable Domain Name | Inner Variable Domain Name | Sequence 123456789012345678901234567890123456789012345 |
|---|---|---|---|---|
| 114 | DVD1591H | AB269VH | AB273VH | EVQLVESGGGVVQPGRSLRLSCSASGFI FSRYDMSWVRQAPGKGLEWVAYISHGGA GTYYPDSVKGRFTISRDNSKNTLFLQMD SLRAEDTAVYYCARGGVYKGYFDVWGQG TPVTVSSASTKGPEVQLVQSGAEVKKPG SSVKVSCKASGYTFTDYEIHWVRQAPGQ GLEWMGVNDPESGGTFYNQKFDGRVTLT ADESTSTAYMELSSLRSEDTAVYYCTRY SKWDSFDGMDYWGQGTTVTVSS |
| 115 | DVD1591L | AB269VL | AB273VL | DIQMTQSPSSLSASVGDRVTITCRASGN IHNYLTWYQQTPGKAPKLLIYNAKTLAD GVPSRFSGSGSGTDYTFTISSLQPEDIA TYYCQHFWSIPYTFGQGTKLQITRTVAA PSVFIFPPDIQMTQSPSSLSASVGDRVT ITCRASSGIISYIDWFQQKPGKAPKRLI YATFDLASGVPSRFSGSGSGTDYTLTIS SLQPEDFATYYCRQVGSYPETFGQGTKL EIKR |
| 116 | DVD1592H | AB273VH | AB269VH | EVQLVQSGAEVKKPGSSVKVSCKASGYT FTDYEIHWVRQAPGQGLEWMGVNDPESG GTFYNQKFDGRVTLTADESTSTAYMELS SLRSEDTAVYYCTRYSKWDSFDGMDYWG QGTTVTVSSASTKGPEVQLVESGGGVVQ PGRSLRLSCSASGFIFSRYDMSWVRQAP GKGLEWVAYISHGGAGTYYPDSVKGRFT ISRDNSKNTLFLQMDSLRAEDTAVYYCA RGGVYKGYFDVWGQGTPVTVSS |

TABLE 30-continued

| SEQ ID NO | DVD Variable Domain Name | Outer Variable Domain Name | Inner Variable Domain Name | Sequence 123456789012345678901234567890123456789012345 |
|---|---|---|---|---|
| 117 | DVD1592L | AB273VL | AB269VL | DIQMTQSPSSLSASVGDRVTITCRASSG IISYIDWFQQKPGKAPKRLIYATFDLAS GVPSRFSGSGSGTDYTLTISSLQPEDFA TYYCRQVGSYPETFGQGTKLEIKRTVAA PSVFIFPPDIQMTQSPSSLSASVGDRVT ITCRASGNIHNYLTWYQQTPGKAPKLLI YNAKTLADGVPSRFSGSGSGTDYTFTIS SLQPEDIATYYCQHFWSIPYTFGQGTKL QITR |

Example 2.18

Generation of IL-1β (Seq. 3) and IL-17 (Seq. 1) DVD-Igs with Linker Set 2

TABLE 31

| SEQ ID NO | DVD Variable Domain Name | Outer Variable Domain Name | Inner Variable Domain Name | Sequence 123456789012345678901234567890123456789012345 |
|---|---|---|---|---|
| 118 | DVD1593H | AB270VH | AB273VH | EVQLQESGPGLVKPSETLSLTCTVSGFS LSDYGVSWIRQPPGKGLEWLGLIWGGGD TYYNSPLKSRLTISKDNSKSQVSLKLSS VTAADTAVYYCAKQRTLWGYDLYGMDYW GQGTLVTVSSASTKGPEVQLVQSGAEVK KPGSSVKVSCKASGYTFTDYEIHWVRQA PGQGLEWMGVNDPESGGTFYNQKFDGRV TLTADESTSTAYMELSSLRSEDTAVYYC TRYSKWDSFDGMDYWGQGTTVTVSS |
| 119 | DVD1593L | AB270VL | AB273VL | DTQVTQSPSSLSASVGDRVTITCITSTD IDVDMNWYQQKPGKPPKLLISQGNTLRP GVPSRFSSSGSGTDFTFTISSLQPEDFA TYYCLQSDNLPLTFGQGTKLEIKRTVAA PSVFIFPPDIQMTQSPSSLSASVGDRVT ITCRASSGIISYIDWFQQKPGKAPKRLI YATFDLASGVPSRFSGSGSGTDYTLTIS SLQPEDFATYYCRQVGSYPETFGQGTKL EIKR |
| 120 | DVD1594H | AB273VH | AB270VH | EVQLVQSGAEVKKPGSSVKVSCKASGYT FTDYEIHWVRQAPGQGLEWMGVNDPESG GTFYNQKFDGRVTLTADESTSTAYMELS SLRSEDTAVYYCTRYSKWDSFDGMDYWG QGTTVTVSSASTKGPEVQLQESGPGLVK PSETLSLTCTVSGFSLSDYGVSWIRQPP GKGLEWLGLIWGGGDTYYNSPLKSRLTI SKDNSKSQVSLKLSSVTAADTAVYYCAK QRTLWGYDLYGMDYWGQGTLVTVSS |
| 121 | DVD1594L | AB273VL | AB270VL | DIQMTQSPSSLSASVGDRVTITCRASSG IISYIDWFQQKPGKAPKRLIYATFDLAS GVPSRFSGSGSGTDYTLTISSLQPEDFA TYYCRQVGSYPETFGQGTKLEIKRTVAA PSVFIFPPDTQVTQSPSSLSASVGDRVT ITCITSTDIDVDMNWYQQKPGKPPKLLI SQGNTLRPGVPSRFSSSGSGTDFTFTIS SLQPEDFATYYCLQSDNLPLTFGQGTKL EIKR |

Example 2.19

Generation of IL-1β (Seq. 4) and IL-17 (Seq. 1) DVD-Igs with Linker Set 2

TABLE 32

| SEQ ID NO | DVD Variable Domain Name | Outer Variable Domain Name | Inner Variable Domain Name | Sequence 123456789012345678901234567890123456789012345 |
|---|---|---|---|---|
| 122 | DVD1595H | AB271VH | AB273VH | EVQLQESGPGLVKPSETLSLTCTVSGFSLSDYGVSWIRQPPGKGLEWLGLIWGGGDTYYNSPLKSRLTISKDNSKSQVSLKLSSVTAADTAVYYCAKQRTLWGYDLYGMDYWGQGTLVTVSSASTKGPEVQLVQSGAEVKKPGSSVKVSCKASGYTFTDYEIHWVRQAPGQGLEWMGVNDPESGGTFYNQKFDGRVTLTADESTSTAYMELSSLRSEDTAVYYCTRYSKWDSFDGMDYWGQGTTVTVSS |
| 123 | DVD1595L | AB271VL | AB273VL | DTVVTQSPAFLSVTPGEKVTITCITSTDIDVDMNWYQQKPDQPPKLLISQGNTLRPGVPSRFSSSGSGTDFTFTISSLEAEDAATYYCLQSDNLPLTFGQGTKLEIKRTVAAPSVFIFPPDIQMTQSPSSLSASVGDRVTITCRASSGIISYIDWFQQKPGKAPKRLIYATFDLASGVPSRFSGSGSGTDYTLTISSLQPEDFATYYCRQVGSYPETFGQGTKLEIKR |
| 124 | DVD1596H | AB273VH | AB271VH | EVQLVQSGAEVKKPGSSVKVSCKASGYTFTDYEIHWVRQAPGQGLEWMGVNDPESGGTFYNQKFDGRVTLTADESTSTAYMELSSLRSEDTAVYYCTRYSKWDSFDGMDYWGQGTTVTVSSASTKGPEVQLQESGPGLVKPSETLSLTCTVSGFSLSDYGVSWIRQPPGKGLEWLGLIWGGGDTYYNSPLKSRLTISKDNSKSQVSLKLSSVTAADTAVYYCAKQRTLWGYDLYGMDYWGQGTLVTVSS |
| 125 | DVD1596L | AB273VL | AB271VL | DIQMTQSPSSLSASVGDRVTITCRASSGIISYIDWFQQKPGKAPKRLIYATFDLASGVPSRFSGSGSGTDYTLTISSLQPEDFATYYCRQVGSYPETFGQGTKLEIKRTVAAPSVFIFPPDTVVTQSPAFLSVTPGEKVTITCITSTDIDVDMNWYQQKPDQPPKLLISQGNTLRPGVPSRFSSSGSGTDFTFTISSLEAEDAATYYCLQSDNLPLTFGQGTKLEIKR |

Example 2.20

Generation of IL-1β (Seq. 5) and IL-17 (Seq. 1) DVD-Igs with Linker Set 2

TABLE 33

| SEQ ID NO | DVD Variable Domain Name | Outer Variable Domain Name | Inner Variable Domain Name | Sequence 123456789012345678901234567890123456789012345 |
|---|---|---|---|---|
| 126 | DVD1597H | AB272VH | AB273VH | EVQLVESGGGLVQPGGSLRLSCAVSGFTLSDYGVSWIRQAPGKGLEWLGLIWGGGDTYYNSPLKSRLTISKDNSKSTVYLQMNSLRAEDTAVYYCAKQRTLWGYDLYGMDYWGQGTLVTVSSASTKGPEVQLVQSGAEVKKPGSSVKVSCKASGYTFTDYEIHWVRQAPGQGLEWMGVNDPESGGTFYNQKFDGRVTLTADESTSTAYMELSSLRSEDTAVYYCTRYSKWDSFDGMDYWGQGTTVTVSS |
| 127 | DVD1597L | AB272VL | AB273VL | ETTVTQSPSSLSASVGDRVTITCITSTDIDVDMNWYQQKPGKPPKLLISQGNTLRPGVPSRFSSSGSGTDFTFTISSLQPEDFATYYCLQSDNLPLTFGQGTKLEIKRTVAAPSVFIFPPDIQMTQSPSSLSASVGDRVT |

TABLE 33-continued

| SEQ ID NO | DVD Variable Domain Name | Outer Variable Domain Name | Inner Variable Domain Name | Sequence 123456789012345678901234567890123456789012345 |
|---|---|---|---|---|
| | | | | ITCRASSGIISYIDWFQQKPGKAPKRLIYATFDLASGVPSRFSGSGSGTDYTLTISSLQPEDFATYYCRQVGSYPETFGQGTKLEIKR |
| 128 | DVD1598H | AB273VH | AB272VH | EVQLVQSGAEVKKPGSSVKVSCKASGYTFTDYEIHWVRQAPGQGLEWMGVNDPESGGTFYNQKFDGRVTLTADESTSTAYMELSSLRSEDTAVYYCTRYSKWDSFDGMDYWGQGTTVTVSSASTKGPEVQLVESGGGLVQPGGSLRLSCAVSGFTLSDYGVSWIRQAPGKGLEWLGLIWGGGDTYYNSPLKSRLTISKDNSKSTVYLQMNSLRAEDTAVYYCAKQRTLWGYDLYGMDYWGQGTLVTVSS |
| 129 | DVD1598L | AB273VL | AB272VL | DIQMTQSPSSLSASVGDRVTITCRASSGIISYIDWFQQKPGKAPKRLIYATFDLASGVPSRFSGSGSGTDYTLTISSLQPEDFATYYCRQVGSYPETFGQGTKLEIKRTVAAPSVFIFPPETTVTQSPSSLSASVGDRVTITCITSTDIDVDMNWYQQKPGKPPKLLISQGNTLRPGVPSRFSSSGSGTDFTFTISSLQPEDFATYYCLQSDNLPLTFGQGTKLEIKR |

Example 2.21

Generation of IL-1β (Seq. 1) and IL-17 (Seq. 2) DVD-Igs with Linker Set 2

TABLE 34

| SEQ ID NO | DVD Variable Domain Name | Outer Variable Domain Name | Inner Variable Domain Name | Sequence 1234567890123456789012345678901234567 |
|---|---|---|---|---|
| 130 | DVD1599H | AB268VH | AB274VH | EVQLVESGGGVVQPGRSLRLSCSASGFIFSRYDMSWVRQAPGKGLEWVAYISHGGAGTYYPDSVKGRFTISRDNSKNTLFLQMDSLRPEDTGVYFCARGGVTKGYFDVWGQGTPVTVSSASTKGPEVQLVQSGAEVKKPGSSVKVSCKASGGSFGGYGIGWVRQAPGQGLEWMGGITPFFGFADYAQKFQGRVTITADESTTTAYMELSGLTSDDTAVYYCARDPNEFWNGYYSTHDFDSWGQGTTVTVSS |
| 131 | DVD1599L | AB268VL | AB274VL | DIQMTQSPSSLSASVGDRVTITCRASGNIHNYLTWYQQTPGKAPKLLIYNAKTLADGVPSRFSGSGSGTDYTFTISSLQPEDIATYYCQHFWSIPYTFGQGTKLQITRTVAAPSVFIFPPEIVLTQSPDFQSVTPKEKVTITCRASQDIGSELHWYQQKPDQPPKLLIKYASHSTGVPSRFSGSGSGTDFTLTINGLEAEDAGTYYCHQTDSLPYTFGPGTKVDIKR |
| 132 | DVD1600H | AB274VH | AB268VH | EVQLVQSGAEVKKPGSSVKVSCKASGGSFGGYGIGWVRQAPGQGLEWMGGITPFFGFADYAQKFQGRVTITADESTTTAYMELSGLTSDDTAVYYCARDPNEFWNGYYSTHDFDSWGQGTTVTVSSASTKGPEVQLVESGGGVVQPGRSLRLSCSASGFIFSRYDMSWVRQAPGKGLEWVAYISHGGAGTYYPDSVKGRFTISRDNSKNTLFLQMDSLRPEDTGVYFCARGGVTKGYFDVWGQGTPVTVSS |

TABLE 34-continued

| SEQ ID NO | DVD Variable Domain Name | Outer Variable Domain Name | Inner Variable Domain Name | Sequence 123456789012345678901234567 89012345 |
|---|---|---|---|---|
| 133 | DVD1600L | AB274VL | AB268VL | EIVLTQSPDFQSVTPKEKVTITCRASQ DIGSELHWYQQKPDQPPKLLIKYASHS TSGVPSRFSGSGSGTDFTLTINGLEAE DAGTYYCHQTDSLPYTFGPGTKVDIKR TVAAPSVFIFPPDIQMTQSPSSLSASV GDRVTITCRASGNIHNYLTWYQQTPGK APKLLIYNAKTLADGVPSRFSGSGSGT DYTFTISSLQPEDIATYYCQHFWSIPY TFGQGTKLQITR |

Example 2.22

Generation of IL-1β (Seq. 2) and IL-17 (Seq. 2) DVD-Igs with Linker Set 2

TABLE 35

| SEQ ID NO | DVD Variable Domain Name | Outer Variable Domain Name | Inner Variable Domain Name | Sequence 12345678901234567890123456789012345 |
|---|---|---|---|---|
| 134 | DVD1601H | AB269VH | AB274VH | EVQLVESGGGVVQPGRSLRLSCSASGFI FSRYDMSWVRQAPGKGLEWVAYISHGGA GTYYPDSVKGRFTISRDNSKNTLFLQMD SLRAEDTAVYYCARGGVYKGYFDVWGQG TPVTVSSASTKGPEVQLVQSGAEVKKPG SSVKVSCKASGGSFGGYIGWVRQAPGQ GLEWMGGITPFFGFADYAQKFQGRVTIT ADESTTTAYMELSGLTSDDTAVYYCARD PNEFWNGYYSTHDFDSWGQGTTVTVSS |
| 135 | DVD1601L | AB269VL | AB274VL | DIQMTQSPSSLSASVGDRVTITCRASGN IHNYLTWYQQTPGKAPKLLIYNAKTLAD GVPSRFSGSGSGTDYTFTISSLQPEDIA TYYCQHFWSIPYTFGQGTKLQITRTVAA PSVFIFPPEIVLTQSPDFQSVTPKEKVT ITCRASQDIGSELHWYQQKPDQPPKLLI KYASHSTSGVPSRFSGSGSGTDFTLTIN GLEAEDAGTYYCHQTDSLPYTFGPGTKV DIKR |
| 136 | DVD1602H | AB274VH | AB269VH | EVQLVQSGAEVKKPGSSVKVSCKASGGS FGGYIGWVRQAPGQGLEWMGGITPFFG FADYAQKFQGRVTITADESTTTAYMELS GLTSDDTAVYYCARDPNEFWNGYYSTHD FDSWGQGTTVTVSSASTKGPEVQLVESG GGVVQPGRSLRLSCSASGFIFSRYDMSW VRQAPGKGLEWVAYISHGGAGTYYPDSV KGRFTISRDNSKNTLFLQMDSLRAEDTA VYYCARGGVYKGYFDVWGQGTPVTVSS |
| 137 | DVD1602L | AB274VL | AB269VL | EIVLTQSPDFQSVTPKEKVTITCRASQD IGSELHWYQQKPDQPPKLLIKYASHSTS GVPSRFSGSGSGTDFTLTINGLEAEDAG TYYCHQTDSLPYTFGPGTKVDIKRTVAA PSVFIFPPDIQMTQSPSSLSASVGDRVT ITCRASGNIHNYLTWYQQTPGKAPKLLI YNAKTLADGVPSRFSGSGSGTDYTFTIS SLQPEDIATYYCQHFWSIPYTFGQGTKL QITR |

Example 2.23

Generation of IL-1β (Seq. 3) and IL-17 (Seq. 2) DVD-Igs with Linker Set 2

TABLE 36

| SEQ ID NO | DVD Variable Domain Name | Outer Variable Domain Name | Inner Variable Domain Name | Sequence 123456789012345678901234567 89012345 |
|---|---|---|---|---|
| 138 | DVD1603H | AB270VH | AB274VH | EVQLQESGPGLVKPSETLSLTCTVSGF SLSDYGVSWIRQPPGKGLEWLGLIWGG GDTYYNSPLKSRLTISKDNSKSQVSLK LSSVTAADTAVYYCAKQRTLWGYDLYG MDYWGQGTLVTVSSASTKGPEVQLVQS GAEVKKPGSSVKVSCKASGGSFGGYGI GWVRQAPGQGLEWMGGITPFFGFADYA QKFQGRVTITADESTTTAYMELSGLTS DDTAVYYCARDPNEFWNGYYSTHDFDS WGQGTTVTVSS |
| 139 | DVD1603L | AB270VL | AB274VL | DTQVTQSPSSLSASVGDRVTITCITST DIDVDMNWYQQKPGKPPKLLISQGNTL RPGVPSRFSSSGSGTDFTFTISSLQPE DFATYYCLQSDNLPLTFGQGTKLEIKR TVAAPSVFIFPPEIVLTQSPDFQSVTP KEKVTITCRASQDIGSELHWYQQKPDQ PPKLLIKYASHSTSGVPSRFSGSGSGT DFTLTINGLEAEDAGTYYCHQTDSLPY TFGPGTKVDIKR |
| 140 | DVD1604H | AB274VH | AB270VH | EVQLVQSGAEVKKPGSSVKVSCKASGG SFGGYGIGWVRQAPGQGLEWMGGITPF FGFADYAQKFQGRVTITADESTTTAYM ELSGLTSDDTAVYYCARDPNEFWNGYY STHDFDSWGQGTTVTVSSASTKGPEVQ LQESGPGLVKPSETLSLTCTVSGFSLS DYGVSWIRQPPGKGLEWLGLIWGGGDT YYNSPLKSRLTISKDNSKSQVSLKLSS VTAADTAVYYCAKQRTLWGYDLYGMDY WGQGTLVTVSS |
| 141 | DVD1604L | AB274VL | AB270VL | EIVLTQSPDFQSVTPKEKVTITCRASQ DIGSELHWYQQKPDQPPKLLIKYASHS TSGVPSRFSGSGSGTDFTLTINGLEAE DAGTYYCHQTDSLPYTFGPGTKVDIKR TVAAPSVFIFPPDTQVTQSPSSLSASV GDRVTITCITSTDIDVDMNWYQQKPGK PPKLLISQGNTLRPGVPSRFSSSGSGT DFTFTISSLQPEDFATYYCLQSDNLPL TFGQGTKLEIKR |

45

Example 2.24

Generation of IL-1β (Seq. 4) and IL-17 (Seq. 2) DVD-Igs with Linker Set 2

TABLE 37

| SEQ ID NO | DVD Variable Domain Name | Outer Variable Domain Name | Inner Variable Domain Name | Sequence 12345678901234567890123456 78 9012345 |
|---|---|---|---|---|
| 142 | DVD1605H | AB271VH | AB274VH | EVQLQESGPGLVKPSETLSLTCTVSGFS LSDYGVSWIRQPPGKGLEWLGLIWGGGD TYYNSPLKSRLTISKDNSKSQVSLKLSS VTAADTAVYYCAKQRTLWGYDLYGMDYW GQGTLVTVSSASTKGPEVQLVQSGAEVK KPGSSVKVSCKASGGSFGGYGIGWVRQA PGQGLEWMGGITPFFGFADYAQKFQGRV TITADESTTTAYMELSGLTSDDTAVYYC ARDPNEFWNGYYSTHDFDSWGQGTTVTV SS |
| 143 | DVD1605L | AB271VL | AB274VL | DTVVTQSPAFLSVTPGEKVTITCITSTD IDVDMNWYQQKPDQPPKLLISQGNTLRP |

TABLE 37-continued

| SEQ ID NO | DVD Variable Domain Name | Outer Variable Domain Name | Inner Variable Domain Name | Sequence 123456789012345678901234567890123456789012345 |
|---|---|---|---|---|
| | | | | GVPSRFSSSGSGTDFTFTISSLEAEDAA TYYCLQSDNLPLTFGQGTKLEIKRTVAA PSVFIFPPEIVLTQSPDFQSVTPKEKVT ITCRASQDIGSELHWYQQKPDQPPKLLI KYASHSTSGVPSRFSGSGSGTDFTLTIN GLEAEDAGTYYCHQTDSLPYTFGPGTKV DIKR |
| 144 | DVD1606H | AB274VH | AB271VH | EVQLVQSGAEVKKPGSSVKVSCKASGGS FGGYGIGWVRQAPGQGLEWMGGITPFFG FADYAQKFQGRVTITADESTTTAYMELS GLTSDDTAVYYCARDPNEFWNGYYSTHD FDSWGQGTTVTSSASTKGPEVQLQESG PGLVKPSETLSLTCTVSGFSLSDYGVSW IRQPPGKGLEWLGLIWGGGDTYYNSPLK SRLTISKDNSKSQVSLKLSSVTAADTAV YYCAKQRTLWGYDLYGMDYWGQGTLVTV SS |
| 145 | DVD1606L | AB274VL | AB271VL | EIVLTQSPDFQSVTPKEKVTITCRASQD IGSELHWYQQKPDQPPKLLIKYASHSTS GVPSRFSGSGSGTDFTLTINGLEAEDAG TYYCHQTDSLPYTFGPGTKVDIKRTVAA PSVFIFPPDTVVTQSPAFLSVTPGEKVT ITCITSTDIDVDMNWYQQKPDQPPKLLI SQGNTLRPGVPSRFSSSGSGTDFTFTIS SLEAEDAATYYCLQSDNLPLTFGQGTKL EIKR |

Example 2.25

Generation of IL-1β (Seq. 5) and IL-17 (Seq. 2) DVD-Igs with Linker Set 2

TABLE 38

| SEQ ID NO | DVD Variable Domain Name | Outer Variable Domain Name | Inner Variable Domain Name | Sequence 123456789012345678901234567890123456789012345 |
|---|---|---|---|---|
| 146 | DVD1607H | AB272VH | AB274VH | EVQLVESGGGLVQPGGSLRLSCAVSGFT LSDYGVSWIRQAPGKGLEWLGLIWGGGD TYYNSPLKSRLTISKDNSKSTVYLQMNS LRAEDTAVYYCAKQRTLWGYDLYGMDYW GQGTLVTVSSASTKGPEVQLVQSGAEVK KPGSSVKVSCKASGGSFGGYGIGWVRQA PGQGLEWMGGITPFFGFADYAQKFQGRV TITADESTTTAYMELSGLTSDDTAVYYC ARDPNEFWNGYYSTHDFDSWGQGTTVTV SS |
| 147 | DVD1607L | AB272VL | AB274VL | ETTVTQSPSSLSASVGDRVTITCITSTD IDVDMNWYQQKPGKPPKLLISQGNTLRP GVPSRFSSSGSGTDFTFTISSLQPEDFA TYYCLQSDNLPLTFGQGTKLEIKRTVAA PSVFIFPPEIVLTQSPDFQSVTPKEKVT ITCRASQDIGSELHWYQQKPDQPPKLLI KYASHSTSGVPSRFSGSGSGTDFTLTIN GLEAEDAGTYYCHQTDSLPYTFGPGTKV DIKR |
| 148 | DVD1608H | AB274VH | AB272VH | EVQLVQSGAEVKKPGSSVKVSCKASGGS FGGYGIGWVRQAPGQGLEWMGGITPFFG FADYAQKFQGRVTITADESTTTAYMELS GLTSDDTAVYYCARDPNEFWNGYYSTHD FDSWGQGTTVTVSSASTKGPEVQLVESG GGLVQPGGSLRLSCAVSGFTLSDYGVSW IRQAPGKGLEWLGLIWGGGDTYYNSPLK SRLTISKDNSKSTVYLQMNSLRAEDTAV YYCAKQRTLWGYDLYGMDYWGQGTLVTV SS |

TABLE 38-continued

| SEQ ID NO | DVD Variable Domain Name | Outer Variable Domain Name | Inner Variable Domain Name | Sequence 123456789012345678901234567890123456789012345 |
|---|---|---|---|---|
| 149 | DVD1608L | AB274VL | AB272VL | EIVLTQSPDFQSVTPKEKVTITCRASQD IGSELHWYQQKPDQPPKLLIKYASHSTS GVPSRFSGSGSGTDFTLTINGLEAEDAG TYYCHQTDSLPYTFGPGTKVDIKRTVAA PSVFIFPPETTVTQSPSSLSASVGDRVT ITCITSTDIDVDMNWYQQKPGKPPKLLI SQGNTLRPGVPSRFSSGSGTDFTFTIS SLQPEDFATYYCLQSDNLPLTFGQGTKL EIKR |

Example 2.26

Generation of IL-1β (Seq. 1) and IL-17 (Seq. 3) DVD-Igs with Linker Set 2

TABLE 39

| SEQ ID NO | DVD Variable Domain Name | Outer Variable Domain Name | Inner Variable Domain Name | Sequence 123456789012345678901234567890123456789012345 |
|---|---|---|---|---|
| 150 | DVD1609H | AB268VH | AB275VH | EVQLVESGGGVVQPGRSLRLSCSASGFI FSRYDMSWVRQAPGKGLEWVAYISHGGA GTYYPDSVKGRFTISRDNSKNTLFLQMD SLRPEDTGVYFCARGGVTKGYFDVWGQG TPVTVSSASTKGPEVQLVQSGAEVKKPG ESVKISCKASGGSFRSYGISWVRQAPGQ GLEWMGGITHFFGITDYAQKFQGRVTIT ADESTTTAYMELSGLTSDDTAVYYCARE PNDFWNGYYDTHDFDSWGQGTTVTVSS |
| 151 | DVD1609L | AB268VL | AB275VL | DIQMTQSPSSLSASVGDRVTITCRASGN IHNYLTWYQQTPGKAPKLLIYNAKTLAD GVPSRFSGSGSGTDYTFTISSLQPEDIA TYYCQHFWSIPYTFGQGTKLQITRTVAA PSVFIFPPEIVLTQSPDFQSVTPKEKVT ITCRASQNIGSELHWYQQKPDQSPKLLI KYASHSISGVPSRFSGSGSGTDFTLTIN GLEAEDAATYYCHQSDTLPHTFGQGTKV DIKR |
| 152 | DVD1610H | AB275VH | AB268VH | EVQLVQSGAEVKKPGESVKISCKASGGS FRSYGISWVRQAPGQGLEWMGGITHFFG ITDYAQKFQGRVTITADESTTTAYMELS GLTSDDTAVYYCAREPNDFWNGYYDTHD FDSWGQGTTVTVSSASTKGPEVQLVESG GGVVQPGRSLRLSCSASGFIFSRYDMSW VRQAPGKGLEWVAYISHGGAGTYYPDSV KGRFTISRDNSKNTLFLQMDSLRPEDTG VYFCARGGVTKGYFDVWGQGTPVTVSS |
| 153 | DVD1610L | AB275VL | AB268VL | EIVLTQSPDFQSVTPKEKVTITCRASQN IGSELHWYQQKPDQSPKLLIKYASHSIS GVPSRFSGSGSGTDFTLTINGLEAEDAA TYYCHQSDTLPHTFGQGTKVDIKRTVAA PSVFIFPPDIQMTQSPSSLSASVGDRVT ITCRASGNIHNYLTWYQQTPGKAPKLLI YNAKTLADGVPSRFSGSGSGTDYTFTIS SLQPEDIATYYCQHFWSIPYTFGQGTKL QITR |

Example 2.27

Generation of IL-1β (Seq. 2) and IL-17 (Seq. 3) DVD-Igs with Linker Set 2

TABLE 40

| SEQ ID NO | DVD Variable Domain Name | Outer Variable Domain Name | Inner Variable Domain Name | Sequence 123456789012345678901234567890123456789012345 |
|---|---|---|---|---|
| 154 | DVD1611H | AB269VH | AB275VH | EVQLVESGGGVVQPGRSLRLSCSASGFIFSRYDMSWVRQAPGKGLEWVAYISHGGAGTYYPDSVKGRFTISRDNSKNTLFLQMDSLRAEDTAVYYCARGGVYKGYFDVWGQGTPVTVSSASTKGPEVQLVQSGAEVKKPGESVKISCKASGGSFRSYGISWVRQAPGQGLEWMGGITHFFGITDYAQKFQGRVTITADESTTTAYMELSGLTSDDTAVYYCAREPNDFWNGYYDTHDFDSWGQGTTVTVSS |
| 155 | DVD1611L | AB269VL | AB275VL | DIQMTQSPSSLSASVGDRVTITCRASGNIHNYLTWYQQTPGKAPKLLIYNAKTLADGVPSRFSGSGSGTDYTFTISSLQPEDIATYYCQHFWSIPYTFGQGTKLQITRTVAAPSVFIFPPEIVLTQSPDFQSVTPKEKVTITCRASQNIGSELHWYQQKPDQSPKLLIKYASHSISGVPSRFSGSGSGTDFTLTINGLEAEDAATYYCHQSDTLPHTFGQGTKVDIKR |
| 156 | DVD1612H | AB275VH | AB269VH | EVQLVQSGAEVKKPGESVKISCKASGGSFRSYGISWVRQAPGQGLEWMGGITHFFGITDYAQKFQGRVTITADESTTTAYMELSGLTSDDTAVYYCAREPNDFWNGYYDTHDFDSWGQGTTVTVSSASTKGPEVQLVESGGGVVQPGRSLRLSCSASGFIFSRYDMSWVRQAPGKGLEWVAYISHGGAGTYYPDSVKGRFTISRDNSKNTLFLQMDSLRAEDTAVYYCARGGVYKGYFDVWGQGTPVTVSS |
| 157 | DVD1612L | AB275VL | AB269VL | EIVLTQSPDFQSVTPKEKVTITCRASQNIGSELHWYQQKPDQSPKLLIKYASHSISGVPSRFSGSGSGTDFTLTINGLEAEDAATYYCHQSDTLPHTFGQGTKVDIKRTVAAPSVFIFPPDIQMTQSPSSLSASVGDRVTITCRASGNIHNYLTWYQQTPGKAPKLLIYNAKTLADGVPSRFSGSGSGTDYTFTISSLQPEDIATYYCQHFWSIPYTFGQGTKLQITR |

Example 2.28

Generation of IL-1β (Seq. 3) and IL-17 (Seq. 3) DVD-Igs with Linker Set 2

TABLE 41

| SEQ ID NO | DVD Variable Domain Name | Outer Variable Domain Name | Inner Variable Domain Name | Sequence 123456789012345678901234567890123456789012345 |
|---|---|---|---|---|
| 158 | DVD1613H | AB270VH | AB275VH | EVQLQESGPGLVKPSETLSLTCTVSGFSLSDYGVSWIRQPPGKGLEWLGLIWGGGDTYYNSPLKSRLTISKDNSKSQVSLKLSSVTAADTAVYYCAKQRTLWGYDLYGMDYWGQGTLVTVSSASTKGPEVQLVQSGAEVKKPGESVKISCKASGGSFRSYGISWVRQAPGQGLEWMGGITHFFGITDYAQKFQGRVTITADESTTTAYMELSGLTSDDTAVYYCAREPNDFWNGYYDTHDFDSWGQGTTVTVSS |
| 159 | DVD1613L | AB270VL | AB275VL | DTQVTQSPSSLSASVGDRVTITCITSTDIDVDMNWYQQKFGKPPKLLISQGNTLRPGVPSRFSSSGSGTDFTFTISSLQPEDFATYYCLQSDNLPLTFGQGTKLEIKRTVAA |

TABLE 41-continued

| SEQ ID NO | DVD Variable Domain Name | Outer Variable Domain Name | Inner Variable Domain Name | Sequence 123456789012345678901234567890123456789012345 |
|---|---|---|---|---|
| | | | | PSVFIFPPEIVLTQSPDFQSVTPKEKVT ITCRASQNIGSELHWYQQKFDQSPKLLI KYASHSISGVPSRFSGSGSGTDFTLTIN GLEAEDAATYYCHQSDTLPHTFGQGTKV DIKR |
| 160 | DVD1614H | AB275VH | AB270VH | EVQLVQSGAEVKKPGESVKISCKASGGS FRSYGISWVRQAPGQGLEWMGGITHFFG ITDYAQKFQGRVTITADESTTTAYMELS GLTSDDTAVYYCAREPNDFWNGYYDTHD FDSWGQGTTVTVSSASTKGPEVQLQESG PGLVKPSETLSLTCTVSGFSLSDYGVSW IRQPPGKGLEWLGLIWGGGDTYYNSPLK SRLTISKDNSKSQVSLKLSSVTAADTAV YYCAKQRTLWGYDLYGMDYWGQGTLVTV SS |
| 161 | DVD1614L | AB275VL | AB270VL | EIVLTQSPDFQSVTPKEKVTITCRASQN IGSELHWYQQKPDQSPKLLIKYASHSIS GVPSRFSGSGSGTDFTLTINGLEAEDAA TYYCHQSDTLPHTFGQGTKVDIKRTVAA PSVFIFPPDTQVTQSPSSLSASVGDRVT ITCITSTDIDVDMNWYQQKPGKPPKLLI SQGNTLRPGVPSRFSSSGSGTDFTFTIS SLQPEDFATYYCLQSDNLPLTFGQGTKL EIKR |

Example 2.29

Generation of IL-1β (Seq. 4) and IL-17 (Seq. 3) DVD-Igs with Linker Set 2

TABLE 42

| SEQ ID NO | DVD Variable Domain Name | Outer Variable Domain Name | Inner Variable Domain Name | Sequence 123456789012345678901234567890123456789012345 |
|---|---|---|---|---|
| 162 | DVD1615H | AB271VH | AB275VH | EVQLQESGPGLVKPSETLSLTCTVSGFS LSDYGVSWIRQPPGKGLEWLGLIWGGGD TYYNSPLKSRLTISKDNSKSQVSLKLSS VTAADTAVYYCAKQRTLWGYDLYGMDYW GQGTLVTVSSASTKGPEVQLVQSGAEVK KPGESVKISCKASGGSFRSYGISWVRQA PGQGLEWMGGITHFFGITDYAQKFQGRV TITADESTTTAYMELSGLTSDDTAVYYC AREPNDFWNGYYDTHDFDSWGQGTTVTV SS |
| 163 | DVD1615L | AB271VL | AB275VL | DTVVTQSPAFLSVTPGEKVTITCITSTD IDVDMNWYQQKFDQPPKLLISQGNTLRP GVPSRFSSSGSGTDFTFTISSLEAEDAA TYYCLQSDNLPLTFGQGTKLEIKRTVAA PSVFIFPPEIVLTQSPDFQSVTPKEKVT ITCRASQNIGSELHWYQQKPDQSFKLLI KYASHSISGVPSRFSGSGSGTDFTLTIN GLEAEDAATYYCHQSDTLPHTFGQGTKV DIKR |
| 164 | DVD1616H | AB275VH | AB271VH | EVQLVQSGAEVKKPGESVKISCKASGGS FRSYGISWVRQAPGQGLEWMGGITHFFG ITDYAQKFQGRVTITADESTTTAYMELS GLTSDDTAVYYCAREPNDFWNGYYDTHD FDSWGQGTTVTVSSASTKGPEVQLQESG PGLVKPSETLSLTCTVSGFSLSDYGVSW IRQPPGKGLEWLGLIWGGGDTYYNSPLK SRLTISKDNSKSQVSLKLSSVTAADTAV YYCAKQRTLWGYDLYGMDYWGQGTLVTV SS |

TABLE 42-continued

| SEQ ID NO | DVD Variable Domain Name | Outer Variable Domain Name | Inner Variable Domain Name | Sequence 123456789012345678901234567 89012345 |
|---|---|---|---|---|
| 165 | DVD1616L | AB275VL | AB271VL | EIVLTQSPDFQSVTPKEKVTITCRASQN IGSELHWYQQKPDQSPKLLIKYASHSIS GVPSRFSGSGSGTDFTLTINGLEAEDAA TYYCHQSDTLPHTFGQGTKVDIKRTVAA PSVFIFPPDTVVTQSPAFLSVTPGEKVT ITCITSTDIDVDMNWYQQKPDQPPKLLI SQGNTLRPGVPSRFSSSGSGTDFTFTIS SLEAEDAATYYCLQSDNLPLTFGQGTKL EIKR |

Example 2.30

Generation of IL-1β (Seq. 5) and IL-17 (Seq. 3) DVD-Igs with Linker Set 2

TABLE 43

| SEQ ID NO | DVD Variable Domain Name | Outer Variable Domain Name | Inner Variable Domain Name | Sequence 12345678901234567890123 456789012345 |
|---|---|---|---|---|
| 166 | DVD1617H | AB272VH | AB275VH | EVQLVESGGGLVQPGGSLRLSCA VSGFTLSDYGVSWIRQAPGKGLE WLGLIWGGGDTYYNSPLKSRLTI SKDNSKSTVYLQMNSLRAEDTAV YYCAKQRTLWGYDLYGMDYWGQG TLVTVSSASTKGPEVQLVQSGAE VKKPGESVKISCKASGGSFRSYG ISWVRQAPGQGLEWMGGITHFFG ITDYAQKFQGRVTITADESTTTA YMELSGLTSDDTAVYYCAREPND FWNGYYDTHDFDSWGQGTTVTVSS |
| 167 | DVD1617L | AB272VL | AB275VL | ETTVTQSPSSLSASVGDRVTITC ITSTDIDVDMNWYQQKPGKPPKL LISQGNTLRPGVPSRFSSSGSGT DFTFTISSLQPEDFATYYCLQSD NLPLTFGQGTKLEIKRTVAAPSV FIFPPEIVLTQSPDFQSVTPKEK VTITCRASQNIGSELHWYQQKPD QSPKLLIKYASHSISGVPSRFSG SGSGTDFTLTINGLEAEDAATYY CHQSDTLPHTFGQGTKVDIKR |
| 168 | DVD1618H | AB275VH | AB272VH | EVQLVQSGAEVKKPGESVKISCK ASGGSFRSYGISWVRQAPGQGLE WMGGITHFFGITDYAQKFQGRVT ITADESTTTAYMELSGLTSDDTA VYYCAREPNDFWNGYYDTHDFDS WGQGTTVTVSSASTKGPEVQLVE SGGGLVQPGGSLRLSCAVSGFTL SDYGVSWIRQAPGKGLEWLGLIW GGGDTYYNSPLKSRLTISKDNSK STVYLQMNSLRAEDTAVYYCAKQ RTLWGYDLYGMDYWGQGTLVTVSS |
| 169 | DVD1618L | AB275VL | AB272VL | EIVLTQSPDFQSVTPKEKVTITC RASQNIGSELHWYQQKPDQSPKL LIKYASHSISGVPSRFSGSGSGT DFTLTINGLEAEDAATYYCHQSD TLPHTFGQGTKVDIKRTVAAPSV FIFPPETTVTQSPSSLSASVGDR VTITCITSTDIDVDMNWYQQKPG KPPKLLISQGNTLRPGVPSRFSS SGSGTDFTFTISSLQPEDFATYY CLQSDNLPLTFGQGTKLEIKR |

Example 2.31

Generation of IL-1β (Seq. 1) and IL-17 (Seq. 1) DVD-Igs with Linker Set 3

TABLE 44

| SEQ ID NO | DVD Variable Domain Name | Outer Variable Domain Name | Inner Variable Domain Name | Sequence 123456789012345678901234567890123456789012345 |
|---|---|---|---|---|
| 170 | DVD1619H | AB268VH | AB273VH | EVQLVESGGGVVQPGRSLRLSCSASGFIFSRYDMSWVRQAPGKGLEWVAYISHGGAGTYYPDSVKGRFTISRDNSKNTLFLQMDSLRPEDTGVYFCARGGVTKGYFDVWGQGTPVTVSSASTKGPSVFPLAPEVQLVQSGAEVKKPGSSVKVSCKASGYTFTDYEIHWVRQAPGQGLEWMGVNDPESGGTFYNQKFDGRVTLTADESTSTAYMELSSLRSEDTAVYYCTRYSKWDSFDGMDYWGQGTTVTVSS |
| 171 | DVD1619L | AB268VL | AB273VL | DIQMTQSPSSLSASVGDRVTITCRASGNIHNYLTWYQQTPGKAPKLLIYNAKTLADGVPSRFSGSGSGTDYTFTISSLQPEDIATYYCQHFWSIPYTFGQGTKLQITRTVAAPDIQMTQSPSSLSASVGDRVTITCRASSGIISYIDWFQQKPGKAPKRLIYATFDLASGVPSRFSGSGSGTDYTLTISSLQPEDFATYYCRQVGSYPETFGQGTKLEIKR |
| 172 | DVD1620H | AB273VH | AB268VH | EVQLVQSGAEVKKPGSSVKVSCKASGYTFTDYEIHWVRQAPGQGLEWMGVNDPESGGTFYNQKFDGRVTLTADESTSTAYMELSSLRSEDTAVYYCTRYSKWDSFDGMDYWGQGTTVTVSSASTKGPSVFPLAPEVQLVESGGGVVQPGRSLRLSCSASGFIFSRYDMSWVRQAPGKGLEWVAYISHGGAGTYYPDSVKGRFTISRDNSKNTLFLQMDSLRPEDTGVYFCARGGVTKGYFDVWGQGTPVTVSS |
| 173 | DVD1620L | AB273VL | AB268VL | DIQMTQSPSSLSASVGDRVTITCRASSGIISYIDWFQQKPGKAPKRLIYATFDLASGVPSRFSGSGSGTDYTLTISSLQPEDFATYYCRQVGSYPETFGQGTKLEIKRTVAAPDIQMTQSPSSLSASVGDRVTITCRASGNIHNYLTWYQQTPGKAPKLLIYNAKTLADGVPSRFSGSGSGTDYTFTISSLQPEDIATYYCQHFWSIPYTFGQGTKLQITR |

Example 2.32

Generation of IL-1β (Seq. 2) and IL-17 (Seq. 1) DVD-Igs with Linker Set 3

TABLE 45

| SEQ ID NO | DVD Variable Domain Name | Outer Variable Domain Name | Inner Variable Domain Name | Sequence 123456789012345678901234567890123456789012345 |
|---|---|---|---|---|
| 174 | DVD1621H | AB269VH | AB273VH | EVQLVESGGGVVQPGRSLRLSCSASGFIFSRYDMSWVRQAPGKGLEWVAYISHGGAGTYYPDSVKGRFTISRDNSKNTLFLQMDSLRAEDTAVYYCARGGVYKGYFDVWGQGTPVTVSSASTKGPSVFPLAPEVQLVQSGAEVKKPGSSVKVSCKASGYTFTDYEIHWVRQAPGQGLEWMGVNDPESGGTFYNQKFDGRVTLTADESTSTAYMELSSLRSEDTAVYYCTRYSKWDSFDGMDYWGQGTTVTVSS |
| 175 | DVD1621L | AB269VL | AB273VL | DIQMTQSPSSLSASVGDRVTITCRASGNIHNYLTWYQQTPGKAPKLLIYNAKTLADGVPSRFSGSGSGTDYTFTISSLQPEDIATYYCQHFWSIPYTFGQGTKLQITRTVAAP |

TABLE 45-continued

| SEQ ID NO | DVD Variable Domain Name | Outer Variable Domain Name | Inner Variable Domain Name | Sequence 123456789012345678901234567890123456789012345 |
|---|---|---|---|---|
|  |  |  |  | PDIQMTQSPSSLSASVGDRVTITCRASSGIISYIDWFQQKPGKAPKRLIYATFDLASGVPSRFSGSGSGTDYTLTISSLQPEDFATYYCRQVGSYPETFGQGTKLEIKR |
| 176 | DVD1622H | AB273VH | AB269VH | EVQLVQSGAEVKKPGSSVKVSCKASGYTFTDYEIHWVRQAPGQGLEWMGVNDPESGGTFYNQKFDGRVTLTADESTSTAYMELSSLRSEDTAVYYCTRYSKWDSFDGMDYWGQGTTVTVSSASTKGPSVFPLAPEVQLVESGGGVVQPGRSLRLSCSASGFIFSRYDMSWVRQAPGKGLEWVAYISHGGAGTYYPDSVKGRFTISRDNSKNTLFLQMDSLRAEDTAVYYCARGGVYKGYFDVWGQGTPVTVSS |
| 177 | DVD1622L | AB273VL | AB269VL | DIQMTQSPSSLSASVGDRVTITCRASSGIISYIDWFQQKPGKAPKRLIYATFDLASGVPSRFSGSGSGTDYTLTISSLQPEDFATYYCRQVGSYPETFGQGTKLEIKRTVAAPDIQMTQSPSSLSASVGDRVTITCRASGNIHNYLTWYQQTPGKAPKLLIYNAKTLADGVPSRFSGSGSGTDYTFTISSLQPEDIATYYCQHFWSIPYTFGQGTKLQITR |

Example 2.33

Generation of IL-1β (Seq. 3) and IL-17 (Seq. 1) DVD-Igs with Linker Set 3

TABLE 46

| SEQ ID NO | DVD Variable Domain Name | Outer Variable Domain Name | Inner Variable Domain Name | Sequence 123456789012345678901234567890123456789012345 |
|---|---|---|---|---|
| 178 | DVD1623H | AB270VH | AB273VH | EVQLQESGPGLVKPSETLSLTCTVSGFSLSDYGVSWIRQPPGKGLEWLGLIWGGGDTYYNSPLKSRLTISKDNSKSQVSLKLSSVTAADTAVYYCAKQRTLWGYDLYGMDYWGQGTLVTVSSASTKGPSVFPLAPEVQLVQSGAEVKKPGSSVKVSCKASGYTFTDYEIHWVRQAPGQGLEWMGVNDPESGGTFYNQKFDGRVTLTADESTSTAYMELSSLRSEDTAVYYCTRYSKWDSFDGMDYWGQGTTVTVSS |
| 179 | DVD1623L | AB270VL | AB273VL | DTQVTQSPSSLSASVGDRVTITCITSTDIDVDMNWYQQKPGKPPKLLISQGNTLRPGVPSRFSSSGSGTDFTFTISSLQPEDFATYYCLQSDNLPLTFGQGTKLEIKRTVAAPDIQMTQSPSSLSASVGDRVTITCRASSGIISYIDWFQQKPGKAPKRLIYATFDLASGVPSRFSGSGSGTDYTLTISSLQPEDFATYYCRQVGSYPETFGQGTKLEIKR |
| 180 | DVD1624H | AB273VH | AB270VH | EVQLVQSGAEVKKPGSSVKVSCKASGYTFTDYEIHWVRQAPGQGLEWMGVNDPESGGTFYNQKFDGRVTLTADESTSTAYMELSSLRSEDTAVYYCTRYSKWDSFDGMDYWGQGTTVTVSSASTKGPSVFPLAPEVQLQESGPGLVKPSETLSLTCTVSGFSLSDYGVSWIRQPPGKGLEWLGLIWGGGDTYYNSPLKSRLTISKDN |

TABLE 46-continued

| SEQ ID NO | DVD Variable Domain Name | Outer Variable Domain Name | Inner Variable Domain Name | Sequence 123456789012345678901234567890123456789012345 |
|---|---|---|---|---|
| | | | | SKSQVSLKLSSVTAADTAVYYCAKQRTLWGYDLYGMDYWGQGTLVTVSS |
| 181 | DVD1624L | AB273VL | AB270VL | DIQMTQSPSSLSASVGDRVTITCRASSGIISYIDWFQQKPGKAPKRLIYATFDLASGVPSRFSGSGSGTDYTLTISSLQPEDFATYYCRQVGSYPETFGQGTKLEIKRTVAAPDTQVTQSPSSLSASVGDRVTITCITSTDIDVDMNWYQQKPGKPPKLLISQGNTLRPGVPSRFSSSGSGTDFTFTISSLQPEDFATYYCLQSDNLPLTFGQGTKLEIKR |

Example 2.34

Generation of IL-1β (Seq. 4) and IL-17 (Seq. 1) DVD-Igs with Linker Set 3

TABLE 47

| SEQ ID NO | DVD Variable Domain Name | Outer Variable Domain Name | Inner Variable Domain Name | Sequence 123456789012345678901234567890123456789012345 |
|---|---|---|---|---|
| 182 | DVD1625H | AB271VH | AB273VH | EVQLQESGPGLVKPSETLSLTCTVSGFSLSDYGVSWIRQPPGKGLEWLGLIWGGGDTYYNSPLKSRLTISKDNSKSQVSLKLSSVTAADTAVYYCAKQRTLWGYDLYGMDYWGQGTLVTVSSASTKGPSVFPLAPEVQLVQSGAEVKKPGSSVKVSCKASGYTFTDYEIHWVRQAPGQGLEWMGVNDPESGGTFYNQKFDGRVTLTADESTSTAYMELSSLRSEDTAVYYCTRYSKWDSFDGMDYWGQGTTVTVSS |
| 183 | DVD1625L | AB271VL | AB273VL | DTVVTQSPAFLSVTPGEKVTITCITSTDIDVDMNWYQQKPDQPPKLLISQGNTLRPGVPSRFSSSGSGTDFTFTISSLEAEDAATYYCLQSDNLPLTFGQGTKLEIKRTVAAPDIQMTQSPSSLSASVGDRVTITCRASSGIISYIDWFQQKPGKAPKRLIYATFDLASGVPSRFSGSGSGTDYTLTISSLQPEDFATYYCRQVGSYPETFGQGTKLEIKR |
| 184 | DVD1626H | AB273VH | AB271VH | EVQLVQSGAEVKKPGSSVKVSCKASGYTFTDYEIHWVRQAPGQGLEWMGVNDPESGGTFYNQKFDGRVTLTADESTSTAYMELSSLRSEDTAVYYCTRYSKWDSFDGMDYWGQGTTVTVSSASTKGPSVFPLAPEVQLQESGPGLVKPSETLSLTCTVSGFSLSDYGVSWIRQPPGKGLEWLGLIWGGGDTYYNSPLKSRLTISKDNSKSQVSLKLSSVTAADTAVYYCAKQRTLWGYDLYGMDYWGQGTLVTVSS |
| 185 | DVD1626L | AB273VL | AB271VL | DIQMTQSPSSLSASVGDRVTITCRASSGIISYIDWFQQKPGKAPKRLIYATFDLASGVPSRFSGSGSGTDYTLTISSLQPEDFATYYCRQVGSYPETFGQGTKLEIKRTVAAPDTVVTQSPAFLSVTPGEKVTITCITSTDIDVDMNWYQQKPDQPPKLLISQGNTLRPGVPSRFSSSGSGTDFTFTISSLEAEDAATYYCLQSDNLPLTFGQGTKLEIKR |

Example 2.35

Generation of IL-1β (Seq. 5) and IL-17 (Seq. 1) DVD-Igs with Linker Set 3

TABLE 48

| SEQ ID NO | DVD Variable Domain Name | Outer Variable Domain Name | Inner Variable Domain Name | Sequence 123456789012345678901234567890123456789012345 |
|---|---|---|---|---|
| 186 | DVD1627H | AB272VH | AB273VH | EVQLVESGGGLVQPGGSLRLSCAVSGFTLSDYGVSWIRQAPGKGLEWLGLIWGGGDTYYNSPLKSRLTISKDNSKTVYLQMNSLRAEDTAVYYCAKQRTLWGYDLYGMDYWGQGTLVTVSSASTKGPSVFPLAPEVQLVQSGAEVKKPGSSVKVSCKASGYTFTDYEIHWVRQAPGQGLEWMGVNDPESGGTFYNQKFDGRVTLTADESTSTAYMELSSLRSEDTAVYYCTRYSKWDSFDGMDYWGQGTTVTVSS |
| 187 | DVD1627L | AB272VL | AB273VL | ETTVTQSPSSLSASVGDRVTITCITSTDIDVDMNWYQQKPGKPPKLLISQGNTLRPGVPSRFSSSGSGTDFTFTISSLQPEDFATYYCLQSDNLPLTFGQGTKLEIKRTVAAPDIQMTQSPSSLSASVGDRVTITCRASSGIISYIDWFQQKPGKAPKRLIYATFDLASGVPSRFSGSGSGTDYTLTISSLQPEDFATYYCRQVGSYPETFGQGTKLEIKR |
| 188 | DVD1628H | AB273VH | AB272VH | EVQLVQSGAEVKKPGSSVKVSCKASGYTFTDYEIHWVRQAPGQGLEWMGVNDPESGGTFYNQKFDGRVTLTADESTSTAYMELSSLRSEDTAVYYCTRYSKWDSFDGMDYWGQGTTVTVSSASTKGPSVFPLAPEVQLVESGGGLVQPGGSLRLSCAVSGFTLSDYGVSWIRQAPGKGLEWLGLIWGGGDTYYNSPLKSRLTISKDNSKTVYLQMNSLRAEDTAVYYCAKQRTLWGYDLYGMDYWGQGTLVTVSS |
| 189 | DVD1628L | AB273VL | AB272VL | DIQMTQSPSSLSASVGDRVTITCRASSGIISYIDWFQQKPGKAPKRLIYATFDLASGVPSRFSGSGSGTDYTLTISSLQPEDFATYYCRQVGSYPETFGQGTKLEIKRTVAAPETTVTQSPSSLSASVGDRVTITCITSTDIDVDMNWYQQKPGKPPKLLISQGNTLRPGVPSRFSSSGSGTDFTFTISSLQPEDFATYYCLQSDNLPLTFGQGTKLEIKR |

Example 2.36

Generation of IL-1β (Seq. 1) and IL-17 (Seq. 2) DVD-Igs with Linker Set 3

TABLE 49

| SEQ ID NO | DVD Variable Domain Name | Outer Variable Domain Name | Inner Variable Domain Name | Sequence 123456789012345678901234567890123456789012345 |
|---|---|---|---|---|
| 190 | DVD1629H | AB268VH | AB274VH | EVQLVESGGGVVQPGRSLRLSCSASGFIFSRYDMSWVRQAPGKGLEWVAYISHGGAGTYYPDSVKGRFTISRDNSKNTLFLQMDSLRPEDTGVYFCARGGVTKGYFDVWGQGTPVTVSSASTKGPSVFPLAPEVQLVQSGAEVKKPGSSVKVSCKASGGSFGGYGIGWVRQAPGQGLEWMGGITPFFGFADYAQKFQGRVTITADESTTTAYMELSGLTSDDTAVYYCARDPNEFWNGYYSTHDFDSWGQGTTVTVSS |
| 191 | DVD1629L | AB268VL | AB274VL | DIQMTQSPSSLSASVGDRVTITCRASGNIHNYLTWYQQTPGKAPKLLIYNAKTLADGVPSRFSGSGSGTDYTFTISSLQPEDIATYYCQHFWSIPYTFGQGTKLQITRTVAA |

TABLE 49-continued

| SEQ ID NO | DVD Variable Domain Name | Outer Variable Domain Name | Inner Variable Domain Name | Sequence 123456789012345678901234567 89012345 |
|---|---|---|---|---|
| | | | | PEIVLTQSPDFQSVTPKEKVTITCRASQ DIGSELHWYQQKPDQPPKLLIKYASHST SGVPSRFSGSGSGTDFTLTINGLEAEDA GTYYCHQTDSLPYTFGPGTKVDIKR |
| 192 | DVD1630H | AB274VH | AB268VH | EVQLVQSGAEVKKPGSSVKVSCKASGGS FGGYGIGWVRQAPGQGLEWMGGITPFFG FADYAQKFQGRVTITADESTTTAYMELS GLTSDDTAVYYCARDPNEFWNGYYSTHD FDSWGQGTTVTVSSASTKGPSVFPLAPE VQLVESGGGVVQPGRSLRLSCSASGFIF SRYDMSWVRQAPGKGLEWVAYISHGGAG TYYPDSVKGRFTISRDNSKNTLFLQMDS LRPEDTGVYFCARGGVTKGYFDVWGQGT PVTVSS |
| 193 | DVD1630L | AB274VL | AB268VL | EIVLTQSPDFQSVTPKEKVTITCRASQD IGSELHWYQQKPDQPPKLLIKYASHSTS GVPSRFSGSGSGTDFTLTINGLEAEDAG TYYCHQTDSLPYTFGPGTKVDIKRTVAA PDIQMTQSPSSLSASVGDRVTITCRASG NIHNYLTWYQQTPGKAPKLLIYNAKTLA DGVPSRFSGSGSGTDYTFTISSLQPEDI ATYYCQHFWSIPYTFGQGTKLQITR |

Example 2.37

Generation of IL-1β (Seq. 2) and IL-17 (Seq. 2) DVD-Igs with Linker Set 3

TABLE 50

| SEQ ID NO | DVD Variable Domain Name | Outer Variable Domain Name | Inner Variable Domain Name | Sequence 12345678901234567890123456 789012345 |
|---|---|---|---|---|
| 194 | DVD1631H | AB269VH | AB274VH | EVQLVESGGGVVQPGRSLRLSCSASGF IFSRYDMSWVRQAPGKGLEWVAYISHG GAGTYYPDSVKGRFTISRDNSKNTLFL QMDSLRAEDTAVYYCARGGVYKGYFDV WGQGTPVTVSSASTKGPSVFPLAPEVQ LVQSGAEVKKPGSSVKVSCKASGGSFG GYGIGWVRQAPGQGLEWMGGITPFFGF ADYAQKFQGRVTITADESTTTAYMELS GLTSDDTAVYYCARDPNEFWNGYYSTH DFDSWGQGTTVTVSS |
| 195 | DVD1631L | AB269VL | AB274VL | DIQMTQSPSSLSASVGDRVTITCRASG NIHNYLTWYQQTPGKAPKLLIYNAKTL ADGVPSRFSGSGSGTDYTFTISSLQPE DIATYYCQHFWSIPYTFGQGTKLQITR TVAAPEIVLTQSPDFQSVTPKEKVTIT CRASQDIGSELHWYQQKPDQPPKLLIK YASHSTSGVPSRFSGSGSGTDFTLTIN GLEAEDAGTYYCHQTDSLPYTFGPGTK VDIKR |
| 196 | DVD1632H | AB274VH | AB269VH | EVQLVQSGAEVKKPGSSVKVSCKASGG SFGGYGIGWVRQAPGQGLEWMGGITPF FGFADYAQKFQGRVTITADESTTTAYM ELSGLTSDDTAVYYCARDPNEFWNGYY STHDFDSWGQGTTVTVSSASTKGPSVF PLAPEVQLVESGGGVVQPGRSLRLSCS ASGFIFSRYDMSWVRQAPGKGLEWVAY ISHGGAGTYYPDSVKGRFTISRDNSKN TLFLQMDSLRAEDTAVYYCARGGVYKG YFDVWGQGTPVTVSS |

TABLE 50-continued

| SEQ ID NO | DVD Variable Domain Name | Outer Variable Domain Name | Inner Variable Domain Name | Sequence |
|---|---|---|---|---|
| 197 | DVD1632L | AB274VL | AB269VL | EIVLTQSPDFQSVTPKEKVTITCRASQDIGSELHWYQQKPDQPPKLLIKYASHSTSGVPSRFSGSGSGTDFTLTINGLEAEDAGTYYCHQTDSLPYTFGPGTKVDIKRTVAAPDIQMTQSPSSLSASVGDRVTITCRASGNIHNYLTWYQQTPGKAPKLLIYNAKTLADGVPSRFSGSGSGTDYTFTISSLQPEDIATYYCQHFWSIPYTFGQGTKLQITR |

Example 2.38

Generation of IL-1β (Seq. 3) and IL-17 (Seq. 2) DVD-Igs with Linker Set 3

TABLE 51

| SEQ ID NO | DVD Variable Domain Name | Outer Variable Domain Name | Inner Variable Domain Name | Sequence |
|---|---|---|---|---|
| 198 | DVD1633H | AB270VH | AB274VH | EVQLQESGPGLVKPSETLSLTCTVSGFSLSDYGVSWIRQPPGKGLEWLGLIWGGGDTYYNSPLKSRLTISKDNSKSQVSLKLSSVTAADTAVYYCAKQRTLWGYDLYGMDYWGQGTLVTVSSASTKGPSVFPLAPEVQLVQSGAEVKKPGSSVKVSCKASGGSFGGYGIGWVRQAPGQGLEWMGGITPFFGFADYAQKFQGRVTITADESTTTAYMELSGLTSDDTAVYYCARDPNEFWNGYYSTHDFDSWGQGTTVTVSS |
| 199 | DVD1633L | AB270VL | AB274VL | DTQVTQSPSSLSASVGDRVTITCITSTDIDVDMNWYQQKPGKPPKLLISQGNTLRPGVPSRFSSSGSGTDFTFTISSLQPEDFATYYCLQSDNLPLTFGQGTKLEIKRTVAAPEIVLTQSPDFQSVTPKEKVTITCRASQDIGSELHWYQQKPDQPPKLLIKYASHSTSGVPSRFSGSGSGTDFTLTINGLEAEDAGTYYCHQTDSLPYTFGPGTKVDIKR |
| 200 | DVD1634H | AB274VH | AB270VH | EVQLVQSGAEVKKPGSSVKVSCKASGGSFGGYGIGWVRQAPGQGLEWMGGITPFFGFADYAQKFQGRVTITADESTTTAYMELSGLTSDDTAVYYCARDPNEFWNGYYSTHDFDSWGQGTTVTVSSASTKGPSVFPLAPEVQLQESGPGLVKPSETLSLTCTVSGFSLSDYGVSWIRQPPGKGLEWLGLIWGGGDTYYNSPLKSRLTISKDNSKSQVSLKLSSVTAADTAVYYCAKQRTLWGYDLYGMDYWGQGTLVTVSS |
| 201 | DVD1634L | AB274VL | AB270VL | EIVLTQSPDFQSVTPKEKVTITCRASQDIGSELHWYQQKPDQPPKLLIKYASHSTSGVPSRFSGSGSGTDFTLTINGLEAEDAGTYYCHQTDSLPYTFGPGTKVDIKRTVAAPDTQVTQSPSSLSASVGDRVTITCITSTDIDVDMNWYQQKPGKPPKLLISQGNTLRPGVPSRFSSSGSGTDFTFTISSLQPEDFATYYCLQSDNLPLTFGQGTKLEIKR |

Example 2.39

Generation of IL-1β (Seq. 4) and IL-17 (Seq. 2) DVD-Igs with Linker Set 3

TABLE 52

| SEQ ID NO | DVD Variable Domain Name | Outer Variable Domain Name | Inner Variable Domain Name | Sequence 123456789012345678901234567890123456789012345 |
|---|---|---|---|---|
| 202 | DVD1635H | AB271VH | AB274VH | EVQLQESGPGLVKPSETLSLTCTVSGFSLSDYGVSWIRQPPGKGLEWLGLIWGGGDTYYNSPLKSRLTISKDNSKSQVSLKLSSVTAADTAVYYCAKQRTLWGYDLYGMDYWGQGTLVTVSSASTKGPSVFPLAPEVQLVQSGAEVKKPGSSVKVSCKASGGSFGGYGIGWVRQAPGQGLEWMGGITPFFGFADYAQKFQGRVTITADESTTTAYMELSGLTSDDTAVYYCARDPNEFWNGYYSTHDFDSWGQGTTVTVSS |
| 203 | DVD1635L | AB271VL | AB274VL | DTVVTQSPAFLSVTPGEKVTITCITSTDIDVDMNWYQQKPDQPPKLLISQGNTLRPGVPSRFSSSGSGTDFTFTISSLEAEDAATYYCLQSDNLPLTFGQGTKLEIKRTVAAPEIVLTQSPDFQSVTPKEKVTITCRASQDIGSELHWYQQKPDQPPKLLIKYASHSTSGVPSRFSGSGSGTDFTLTINGLEAEDAGTYYCHQTDSLPYTFGPGTKVDIKR |
| 204 | DVD1636H | AB274VH | AB271VH | EVQLVQSGAEVKKPGSSVKVSCKASGGSFGGYGIGWVRQAPGQGLEWMGGITPFFGFADYAQKFQGRVTITADESTTTAYMELSGLTSDDTAVYYCARDPNEFWNGYYSTHDFDSWGQGTTVTVSSASTKGPSVFPLAPEVQLQESGPGLVKPSETLSLTCTVSGFSLSDYGVSWIRQPPGKGLEWLGLIWGGGDTYYNSPLKSRLTISKDNSKSQVSLKLSSVTAADTAVYYCAKQRTLWGYDLYGMDYWGQGTLVTVSS |
| 205 | DVD1636L | AB274VL | AB271VL | EIVLTQSPDFQSVTPKEKVTITCRASQDIGSELHWYQQKPDQPPKLLIKYASHSTSGVPSRFSGSGSGTDFTLTINGLEAEDAGTYYCHQTDSLPYTFGPGTKVDIKRTVAAPDTVVTQSPAFLSVTPGEKVTITCITSTDIDVDMNWYQQKPDQPPKLLISQGNTLRPGVPSRFSSSGSGTDFTFTISSLEAEDAATYYCLQSDNLPLTFGQGTKLEIKR |

Example 2.40

Generation of IL-1β (Seq. 5) and IL-17 (Seq. 2) DVD-Igs with Linker Set 3

TABLE 53

| SEQ ID NO | DVD Variable Domain Name | Outer Variable Domain Name | Inner Variable Domain Name | Sequence 123456789012345678901234567890123456789012345 |
|---|---|---|---|---|
| 206 | DVD1637H | AB272VH | AB274VH | EVQLVESGGGLVQPGGSLRLSCAVSGFTLSDYGVSWIRQAPGKGLEWLGLIWGGGDTYYNSPLKSRLTISKDNSKSTVYLQMNSLRAEDTAVYYCAKQRTLWGYDLYGMDYWGQGTLVTVSSASTKGPSVFPLAPEVQLVQSGAEVKKPGSSVKVSCKASGGSFGGYGIGWVRQAPGQGLEWMGGITPFFGFADYAQKFQGRVTITADESTTTAYMELSGLTSDDTAVYYCARDPNEFWNGYYSTHDFDSWGQGTTVTVSS |
| 207 | DVD1637L | AB272VL | AB274VL | ETTVTQSPSSLSASVGDRVTITCITSTDIDVDMNWYQQKPGKPPKLLISQGNTLRPGVPSRFSSSGSGTDFTFTISSLQPEDFATYYCLQSDNLPLTFGQGTKLEIKRTVAA |

TABLE 53-continued

| SEQ ID NO | DVD Variable Domain Name | Outer Variable Domain Name | Inner Variable Domain Name | Sequence 123456789012345678901234567890123456789012345 |
|---|---|---|---|---|
|  |  |  |  | PEIVLTQSPDFQSVTPKEKVTITCRASQ DIGSELHWYQQKPDQPPKLLIKYASHST SGVPSRFSGSGSGTDFTLTINGLEAEDA GTYYCHQTDSLPYTFGPGTKVDIKR |
| 208 | DVD1638H | AB274VH | AB272VH | EVQLVQSGAEVKKPGSSVKVSCKASGGS FGGYGIGWVRQAPGQGLEWMGGITPFFG FADYAQKFQGRVTITADESTTTAYMELS GLTSDDTAVYYCARDPNEFWNGYYSTHD FDSWGQGTTVTVSSASTKGPSVFPLAPE VQLVESGGGLVQPGGSLRLSCAVSGFTL SDYGVSWIRQAPGKGLEWLGLIWGGGDT YYNSPLKSRLTISKDNSKSTVYLQMNSL RAEDTAVYYCAKQRTLWGYDLYGMDYWG QGTLVTVSS |
| 209 | DVD1638L | AB274VL | AB272VL | EIVLTQSPDFQSVTPKEKVTITCRASQD IGSELHWYQQKPDQPPKLLIKYASHSTS GVPSRFSGSGSGTDFTLTINGLEAEDAG TYYCHQTDSLPYTFGPGTKVDIKRTVAA PEIVLTQSPSSLSASVGDRVTITCITST DIDVDMNWYQQKPGKPPKLLISQGNTLR PGVPSRFSSSGSGTDFTFTISSLQPEDF ATYYCLQSDNLPLTFGQGTKLEIKR |

Example 2.41

Generation of IL-1β (Seq. 1) and IL-17 (seq. 3) DVD-Igs With Linker Set 3

TABLE 54

| SEQ ID NO | DVD Variable Domain Name | Outer Variable Domain Name | Inner Variable Domain Name | Sequence 123456789012345678901234567890123456789012345 |
|---|---|---|---|---|
| 210 | DVD1639H | AB268VH | AB275VH | EVQLVESGGGVVQPGRSLRLSCSASGFI FSRYDMSWVRQAPGKGLEWVAYISHGGA GTYYPDSVKGRFTISRDNSKNTLFLQMD SLRPEDTGVYFCARGGVTKGYFDVWGQG TPVTVSSASTKGPSVFPLAPEVQLVQSG AEVKKPGESVKISCKASGGSFRSYGISW VRQAPGQGLEWMGGITHFFGITDYAQKF QGRVTITADESTTTAYMELSGLTSDDTA VYYCAREPNDFWNGYYDTHDFDSWGQGT TVTVSS |
| 211 | DVD1639L | AB268VL | AB275VL | DIQMTQSPSSLSASVGDRVTITCRASGN IHNYLTWYQQTPGKAPKLLIYNAKTLAD GVPSRFSGSGSGTDYTFTISSLQPEDIA TYYCQHFWSIPYTFGQGTKLQITRTVAA PEIVLTQSPDFQSVTPKEKVTITCRASQ NIGSELHWYQQKPDQSPKLLIKYASHSI SGVPSRFSGSGSGTDFTLTINGLEAEDA ATYYCHQSDTLPHTFGQGTKVDIKR |
| 212 | DVD1640H | AB275VH | AB268VH | EVQLVQSGAEVKKPGESVKISCKASGGS FRSYGISWVRQAPGQGLEWMGGITHFFG ITDYAQKFQGRVTITADESTTTAYMELS GLTSDDTAVYYCAREPNDFWNGYYDTHD FDSWGQGTTVTVSSASTKGPSVFPLAPE VQLVESGGGVVQPGRSLRLSCSASGFIF SRYDMSWVRQAPGKGLEWVAYISHGGAG TYYPDSVKGRFTISRDNSKNTLFLQMDS LRPEDTGVYFCARGGVTKGYFDVWGQGT PVTVSS |

TABLE 54-continued

| SEQ ID NO | DVD Variable Domain Name | Outer Variable Domain Name | Inner Variable Domain Name | Sequence 1234567890123456789012345678 9012345 |
|---|---|---|---|---|
| 213 | DVD1640L | AB275VL | AB268VL | EIVLTQSPDFQSVTPKEKVTITCRASQN IGSELHWYQQKPDQSPKLLIKYASHSIS GVPSRFSGSGSGTDFTLTINGLEAEDAA TYYCHQSDTLPHTFGQGTKVDIKRTVAA PDIQMTQSPSSLSASVGDRVTITCRASG NIHNYLTWYQQTPGKAPKLLIYNAKTLA DGVPSRFSGSGSGTDYTFTISSLQPEDI ATYYCQHFWSIPYTFGQGTKLQITR |

Example 2.42

Generation of IL-1β (Seq. 2) and IL-17 (Seq. 3) DVD-Igs with Linker Set 3

TABLE 55

| SEQ ID NO | DVD Variable Domain Name | Outer Variable Domain Name | Inner Variable Domain Name | Sequence 1234567890123456789012345 67 89012345 |
|---|---|---|---|---|
| 214 | DVD1641H | AB269VH | AB275VH | EVQLVESGGGVVQPGRSLRLSCSASGF IFSRYDMSWVRQAPGKGLEWVAYISHG GAGTYYPDSVKGRFTISRDNSKNTLFL QMDSLRAEDTAVYYCARGGVYKGYFDV WGQGTPVTVSSASTKGPSVFPLAPEVQ LVQSGAEVKKPGESVKISCKASGGSFR SYGISWVRQAPGQGLEWMGGITHFFGI TDYAQKFQGRVTITADESTTTAYMELS GLTSDDTAVYYCAREPNDFWNGYYDTH DFDSWGQGTTVTVSS |
| 215 | DVD1641L | AB269VL | AB275VL | DIQMTQSPSSLSASVGDRVTITCRASG NIHNYLTWYQQTPGKAPKLLIYNAKTL ADGVPSRFSGSGSGTDYTFTISSLQPE DIATYYCQHFWSIPYTFGQGTKLQITR TVAAPEIVLTQSPDFQSVTPKEKVTIT CRASQNIGSELHWYQQKPDQSPKLLIK YASHSISGVPSRFSGSGSGTDFTLTIN GLEAEDAATYYCHQSDTLPHTFGQGTK VDIKR |
| 216 | DVD1642H | AB275VH | AB269VH | EVQLVQSGAEVKKPGESVKISCKASGG SFRSYGISWVRQAPGQGLEWMGGITHF FGITDYAQKFQGRVTITADESTTTAYM ELSGLTSDDTAVYYCAREPNDFWNGYY DTHDFDSWGQGTTVTVSSASTKGPSVF PLAPEVQLVESGGGVVQPGRSLRLSCS ASGFIFSRYDMSWVRQAPGKGLEWVAY ISHGGAGTYYPDSVKGRFTISRDNSKN TLFLQMDSLRAEDTAVYYCARGGVYKG YFDVWGQGTPVTVSS |
| 217 | DVD1642L | AB275VL | AB269VL | EIVLTQSPDFQSVTPKEKVTITCRASQ NIGSELHWYQQKPDQSPKLLIKYASHS ISGVPSRFSGSGSGTDFTLTINGLEAE DAATYYCHQSDTLPHTFGQGTKVDIKR TVAAPDIQMTQSPSSLSASVGDRVTIT CRASGNIHNYLTWYQQTPGKAPKLLIY NAKTLADGVPSRFSGSGSGTDYTFTIS SLQPEDIATYYCQHFWSIPYTFGQGTK LQITR |

Example 2.43

Generation of IL-1β (Seq. 3) and IL-17 (Seq. 3) DVD-Igs with Linker Set 3

TABLE 56

| SEQ ID NO | DVD Variable Domain Name | Outer Variable Domain Name | Inner Variable Domain Name | Sequence 123456789012345678901234567890123456789012345 |
|---|---|---|---|---|
| 218 | DVD1643H | AB270VH | AB275VH | EVQLQESGPGLVKPSETLSLTCTVSGFSLSDYGVSWIRQPPGKGLEWLGLIWGGGDTYYNSPLKSRLTISKDNSKSQVSLKLSSVTAADTAVYYCAKQRTLWGYDLYGMDYWGQGTLVTVSSASTKGPSVFPLAPEVQLVQSGAEVKKPGESVKISCKASGGSFRSYGISWVRQAPGQGLEWMGGITHFFGITDYAQKFQGRVTITADESTTTAYMELSGLTSDDTAVYYCAREPNDFWNGYYDTHDFDSWGQGTTVTVSS |
| 219 | DVD1643L | AB270VL | AB275VL | DTQVTQSPSSLSASVGDRVTITCITSTDIDVDMNWYQQKPGKPPKLLISQGNTLRPGVPSRFSSSGSGTDFTFTISSLQPEDFATYYCLQSDNLPLTFGQGTKLEIKRTVAAPEIVLTQSPDFQSVTPKEKVTITCRASQNIGSELHWYQQKPDQSPKLLIKYASHSISGVPSRFSGSGSGTDFTLTINGLEAEDAATYYCHQSDTLPHTFGQGTKVDIKR |
| 220 | DVD1644H | AB275VH | AB270VH | EVQLVQSGAEVKKPGESVKISCKASGGSFRSYGISWVRQAPGQGLEWMGGITHFFGITDYAQKFQGRVTITADESTTTAYMELSGLTSDDTAVYYCAREPNDFWNGYYDTHDFDSWGQGTTVTVSSASTKGPSVFPLAPEVQLQESGPGLVKPSETLSLTCTVSGFSLSDYGVSWIRQPPGKGLEWLGLIWGGGDTYYNSPLKSRLTISKDNSKSQVSLKLSSVTAADTAVYYCAKQRTLWGYDLYGMDYWGQGTLVTVSS |
| 221 | DVD1644L | AB275VL | AB270VL | EIVLTQSPDFQSVTPKEKVTITCRASQNIGSELHWYQQKPDQSPKLLIKYASHSISGVPSRFSGSGSGTDFTLTINGLEAEDAATYYCHQSDTLPHTFGQGTKVDIKRTVAAPDTQVTQSPSSLSASVGDRVTITCITSTDIDVDMNWYQQKPGKPPKLLISQGNTLRPGVPSRFSSSGSGTDFTFTISSLQPEDFATYYCLQSDNLPLTFGQGTKLEIKR |

Example 2.44

Generation of IL-1β (Seq. 4) and IL-17 (Seq. 3) DVD-Igs with Linker Set 3

TABLE 57

| SEQ ID NO | DVD Variable Domain Name | Outer Variable Domain Name | Inner Variable Domain Name | Sequence 123456789012345678901234567890123456789012345 |
|---|---|---|---|---|
| 222 | DVD1645H | AB271VH | AB275VH | EVQLQESGPGLVKPSETLSLTCTVSGFSLSDYGVSWIRQPPGKGLEWLGLIWGGGDTYYNSPLKSRLTISKDNSKSQVSLKLSSVTAADTAVYYCAKQRTLWGYDLYGMDYWGQGTLVTVSSASTKGPSVFPLAPEVQLVQSGAEVKKPGESVKISCKASGGSFRSYGISWVRQAPGQGLEWMGGITHFFGITDYAQKFQGRVTITADESTTTAYMELSGLTSDDTAVYYCAREPNDFWNGYYDTHDFDSWGQGTTVTVSS |
| 223 | DVD1645L | AB271VL | AB275VL | DTVVTQSPAFLSVTPGEKVTITCITSTDIDVDMNWYQQKPDQPPKLLISQGNTLRPGVPSRFSSSGSGTDFTFTISSLEAEDAATYYCLQSDNLPLTFGQGTKLEIKRTVAA |

TABLE 57-continued

| SEQ ID NO | DVD Variable Domain Name | Outer Variable Domain Name | Inner Variable Domain Name | Sequence 123456789012345678901234567890123456789012345 |
|---|---|---|---|---|
| | | | | PEIVLTQSPDFQSVTPKEKVTITCRASQNIGSELHWYQQKPDQSPKLLIKYASHSISGVPSRFSGSGSGTDFTLTINGLEAEDAATYYCHQSDTLPHTFGQGTKVDIKR |
| 224 | DVD1646H | AB275VH | AB271VH | EVQLVQSGAEVKKPGESVKISCKASGGSFRSYGISWVRQAPGQGLEWMGGITHFFGITDYAQKFQGRVTITADESTTTAYMELSGLTSDDTAVYYCAREPNDFWNGYYDTHDFDSWGQGTTVTVSSASTKGPSVFPLAPEVQLQESGPGLVKPSETLSLTCTVSGFSLSDYGVSWIRQPPGKGLEWLGLIWGGGDTYYNSPLKSRLTISKDNSKSQVSLKLSSVTAADTAVYYCAKQRTLWGYDLYGMDYWGQGTLVTVSS |
| 225 | DVD1646L | AB275VL | AB271VL | EIVLTQSPDFQSVTPKEKVTITCRASQNIGSELHWYQQKPDQSPKLLIKYASHSISGVPSRFSGSGSGTDFTLTINGLEAEDAATYYCHQSDTLPHTFGQGTKVDIKRTVAAPDTVVTQSPAFLSVTPGEKVTITCITSTDIDVDMNWYQQKPDQPPKLLISQGNTLRPGVPSRFSSSGSGTDFTFTISSLEAEDAATYYCLQSDNLPLTFGQGTKLEIKR |

Example 2.45

Generation of IL-1β (Seq. 5) and IL-17 (Seq. 3) DVD-Igs with Linker Set 3

TABLE 58

| SEQ ID NO | DVD Variable Domain Name | Outer Variable Domain Name | Inner Variable Domain Name | Sequence 123456789012345678901234567890123456789012345 |
|---|---|---|---|---|
| 226 | DVD1647H | AB272VH | AB275VH | EVQLVESGGGLVQPGGSLRLSCAVSGFTLSDYGVSWIRQAPGKGLEWLGLIWGGGDTYYNSPLKSRLTISKDNSKSTVYLQMNSLRAEDTAVYYCAKQRTLWGYDLYGMDYWGQGTLVTVSSASTKGPSVFPLAPEVQLVQSGAEVKKPGESVKISCKASGGSFRSYGISWVRQAPGQGLEWMGGITHFFGITDYAQKFQGRVTITADESTTTAYMELSGLTSDDTAVYYCAREPNDFWNGYYDTHDFDSWGQGTTVTVSS |
| 227 | DVD1647L | AB272VL | AB275VL | ETTVTQSPSSLSASVGDRVTITCITSTDIDVDMNWYQQKPGKPPKLLISQGNTLRPGVPSRFSSSGSGTDFTFTISSLQPEDFATYYCLQSDNLPLTFGQGTKLEIKRTVAAPEIVLTQSPDFQSVTPKEKVTITCRASQNIGSELHWYQQKPDQSPKLLIKYASHSISGVPSRFSGSGSGTDFTLTINGLEAEDAATYYCHQSDTLPHTFGQGTKVDIKR |
| 228 | DVD1648H | AB275VH | AB272VH | EVQLVQSGAEVKKPGESVKISCKASGGSFRSYGISWVRQAPGQGLEWMGGITHFFGITDYAQKFQGRVTITADESTTTAYMELSGLTSDDTAVYYCAREPNDFWNGYYDTHDFDSWGQGTTVTVSSASTKGPSVFPLAPEVQLVESGGGLVQPGGSLRLSCAVSGFTLSDYGVSWIRQAPGKGLEWLGLIWGGGDTYYNSPLKSRLTISKDNSKSTVYLQMNSLRAEDTAVYYCAKQRTLWGYDLYGMDYWGQGTLVTVSS |

TABLE 58-continued

| SEQ ID NO | DVD Variable Domain Name | Outer Variable Domain Name | Inner Variable Domain Name | Sequence 123456789012345678901234567890123456789012345 |
|---|---|---|---|---|
| 229 | DVD1648L | AB275VL | AB272VL | EIVLTQSPDFQSVTPKEKVTITCRASQNIGSELHWYQQKPDQSPKLLIKYASHSISGVPSRFSGSGSGTDFTLTINGLEAEDAATYYCHQSDTLPHTFGQGTKVDIKRTVAAPETTVTQSPSSLSASVGDRVTITCITSTDIDVDMNWYQQKPGKPPKLLISQGNTLRPGVPSRFSSSGSGTDFTFTISSLQPEDFATYYCLQSDNLPLTFGQGTKLEIKR |

Example 2.46

Generation of IL-1β (Seq. 1) and IL-17 (seq. 1) DVD-Igs With Linker Set 4

TABLE 59

| SEQ ID NO | DVD Variable Domain Name | Outer Variable Domain Name | Inner Variable Domain Name | Sequence 123456789012345678901234567890123456789012345 |
|---|---|---|---|---|
| 230 | DVD1649H | AB268VH | AB273VH | EVQLVESGGGVVQPGRSLRLSCSASGFIFSRYDMSWVRQAPGKGLEWVAYISHGGAGTYYPDSVKGRFTISRDNSKNTLFLQMDSLRPEDTGVYFCARGGVTKGYFDVWGQGTPVTVSSASTKGPSVFPLAPEVQLVQSGAEVKKPGSSVKVSCKASGYTFTDYEIHWVRQAPGQGLEWMGVNDPESGGTFYNQKFDGRVTLTADESTSTAYMELSSLRSEDTAVYYCTRYSKWDSFDGMDYWGQGTTVTVSS |
| 231 | DVD1649L | AB268VL | AB273VL | DIQMTQSPSSLSASVGDRVTITCRASGNIHNYLTWYQQTPGKAPKLLIYNAKTLADGVPSRFSGSGSGTDYTFTISSLQPEDIATYYCQHFWSIPYTFGQGTKLQITRTVAAPSVFIFPPDIQMTQSPSSLSASVGDRVTITCRASSGIISYIDWFQQKPGKAPKRLIYATFDLASGVPSRFSGSGSGTDYTLTISSLQPEDFATYYCRQVGSYPETFGQGTKLEIKR |
| 232 | DVD1650H | AB273VH | AB268VH | EVQLVQSGAEVKKPGSSVKVSCKASGYTFTDYEIHWVRQAPGQGLEWMGVNDPESGGTFYNQKFDGRVTLTADESTSTAYMELSSLRSEDTAVYYCTRYSKWDSFDGMDYWGQGTTVTVSSASTKGPSVFPLAPEVQLVESGGGVVQPGRSLRLSCSASGFIFSRYDMSWVRQAPGKGLEWVAYISHGGAGTYYPDSVKGRFTISRDNSKNTLFLQMDSLRPEDTGVYFCARGGVTKGYFDVWGQGTPVTVSS |
| 233 | DVD1650L | AB273VL | AB268VL | DIQMTQSPSSLSASVGDRVTITCRASSGIISYIDWFQQKPGKAPKRLIYATFDLASGVPSRFSGSGSGTDYTLTISSLQPEDFATYYCRQVGSYPETFGQGTKLEIKRTVAAPSVFIFPPDIQMTQSPSSLSASVGDRVTITCRASGNIHNYLTWYQQTPGKAPKLLIYNAKTLADGVPSRFSGSGSGTDYTFTISSLQPEDIATYYCQHFWSIPYTFGQGTKLQITR |

Example 2.47

Generation of IL-1β (Seq. 2) and IL-17 (seq. 1) DVD-Igs With Linker Set 4

TABLE 60

| SEQ ID NO | DVD Variable Domain Name | Outer Variable Domain Name | Inner Variable Domain Name | Sequence 123456789012345678901234567890123456789012345 |
|---|---|---|---|---|
| 234 | DVD1651H | AB269VH | AB273VH | EVQLVESGGGVVQPGRSLRLSCSASGFIFSRYDMSWVRQAPGKGLEWVAYISHGGAGTYYPDSVKGRFTISRDNSKNTLFLQMDSLRAEDTAVYYCARGGVYKGYFDVWGQGTPVTVSSASTKGPSVFPLAPEVQLVQSGAEVKKPGSSVKVSCKASGYTFTDYEIHWVRQAPGQGLEWMGVNDPESGGTFYNQKFDGRVTLTADESTSTAYMELSSLRSEDTAVYYCTRYSKWDSFDGMDYWGQGTTVTVSS |
| 235 | DVD1651L | AB269VL | AB273VL | DIQMTQSPSSLSASVGDRVTITCRASGNIHNYLTWYQQTPGKAPKLLIYNAKTLADGVPSRFSGSGSGTDYTFTISSLQPEDIATYYCQHFWSIPYTFGQGTKLQITRTVAAPSVFIFPPDIQMTQSPSSLSASVGDRVTITCRASSGIISYIDWFQQKPGKAPKRLIYATFDLASGVPSRFSGSGSGTDYTLTISSLQPEDFATYYCRQVGSYPETFGQGTKLEIKR |
| 236 | DVD1652H | AB273VH | AB269VH | EVQLVQSGAEVKKPGSSVKVSCKASGYTFTDYEIHWVRQAPGQGLEWMGVNDPESGGTFYNQKFDGRVTLTADESTSTAYMELSSLRSEDTAVYYCTRYSKWDSFDGMDYWGQGTTVTVSSASTKGPSVFPLAPEVQLVESGGGVVQPGRSLRLSCSASGFIFSRYDMSWVRQAPGKGLEWVAYISHGGAGTYYPDSVKGRFTISRDNSKNTLFLQMDSLRAEDTAVYYCARGGVYKGYFDVWGQGTPVTVSS |
| 237 | DVD1652L | AB273VL | AB269VL | DIQMTQSPSSLSASVGDRVTITCRASSGIISYIDWFQQKPGKAPKRLIYATFDLASGVPSRFSGSGSGTDYTLTISSLQPEDFATYYCRQVGSYPETFGQGTKLEIKRTVAAPSVFIFPPDIQMTQSPSSLSASVGDRVTITCRASGNIHNYLTWYQQTPGKAPKLLIYNAKTLADGVPSRFSGSGSGTDYTFTISSLQPEDIATYYCQHFWSIPYTFGQGTKLQITR |

Example 2.48

Generation of IL-1β (Seq. 3) and IL-17 (seq. 1) DVD-Igs With Linker Set 4

TABLE 61

| SEQ ID NO | DVD Variable Domain Name | Outer Variable Domain Name | Inner Variable Domain Name | Sequence 1234567890123456789012345678901234545 |
|---|---|---|---|---|
| 238 | DVD1653H | AB270VH | AB273VH | EVQLQESGPGLVKPSETLSLTCTVSGFSLSDYGVSWIRQPPGKGLEWLGLIWGGGDTYYNSPLKSRLTISKDNSKSQVSLKLSSVTAADTAVYYCAKQRTLWGYDLYGMDYWGQGTLVTVSSASTKGPSVFPLAPEVQLVQSGAEVKKPGSSVKVSCKASGYTFTDYEIHWVRQAPGQGLEWMGVNDPESGGTFYNQKFDGRVTLTADESTSTAYMELSSLRSEDTAVYYCTRYSKWDSFDGMDYWGQGTTVTVSS |
| 239 | DVD1653L | AB270VL | AB273VL | DTQVTQSPSSLSASVGDRVTITCITSTDIDVDMNWYQQKPGKPPKLLISQGN |

TABLE 61-continued

| SEQ ID NO | DVD Variable Domain Name | Outer Variable Domain Name | Inner Variable Domain Name | Sequence 123456789012345678901234567890123456789012345 |
|---|---|---|---|---|
| | | | | TLRPGVPSRFSSSGSGTDFTFTISSL QPEDFATYYCLQSDNLPLTFGQGTKL EIKRTVAAPSVFIFPPDIQMTQSPSS LSASVGDRVTITCRASSGIISYIDWF QQKPGKAPKRLIYATFDLASGVPSRF SGSGSGTDYTLTISSLQPEDFATYYC RQVGSYPETFGQGTKLEIKR |
| 240 | DVD1654H | AB273VH | AB270VH | EVQLVQSGAEVKKPGSSVKVSCKASG YTFTDYEIHWVRQAPGQGLEWMGVND PESGGTFYNQKFDGRVTLTADESTST AYMELSSLRSEDTAVYYCTRYSKWDS FDGMDYWGQGTTVTVSSASTKGPSVF PLAPEVQLQESGPGLVKPSETLSLTC TVSGFSLSDYGVSWIRQPPGKGLEWL GLIWGGGDTYYNSPLKSRLTISKDNS KSQVSLKLSSVTAADTAVYYCAKQRT LWGYDLYGMDYWGQGTLVTVSS |
| 241 | DVD1654L | AB273VL | AB270VL | DIQMTQSPSSLSASVGDRVTITCRAS SGIISYIDWFQQKPGKAPKRLIYATF DLASGVPSRFSGSGSGTDYTLTISSL QPEDFATYYCRQVGSYPETFGQGTKL EIKRTVAAPSVFIFPPDTQVTQSPSS LSASVGDRVTITCITSTDIDVDMNWY QQKPGKPPKLLISQGNTLRPGVPSRF SSSGSGTDFTFTISSLQPEDFATYYC LQSDNLPLTFGQGTKLEIKR |

Example 2.49

Generation of IL-1β (Seq. 4) and IL-17 (seq. 1) DVD-Igs With Linker Set 4

TABLE 62

| SEQ ID NO | DVD Variable Domain Name | Outer Variable Domain Name | Inner Variable Domain Name | Sequence 123456789012345678901234567 89012345 |
|---|---|---|---|---|
| 242 | DVD1655H | AB271VH | AB273VH | EVQLQESGPGLVKPSETLSLTCTVSGF SLSDYGVSWIRQPPGKGLEWLGLIWGG GDTYYNSPLKSRLTISKDNSKQVSLK LSSVTAADTAVYYCAKQRTLWGYDLYG MDYWGQGTLVTVSSASTKGPSVFPLAP EVQLVQSGAEVKKPGSSVKVSCKASGY TFTDYEIHWVRQAPGQGLEWMGVNDPE SGGTFYNQKFDGRVTLTADESTSTAYM ELSSLRSEDTAVYYCTRYSKWDSFDGM DYWGQGTTVTVSS |
| 243 | DVD1655L | AB271VL | AB273VL | DTVVTQSPAFLSVTPGEKVTITCITST DIDVDMNWYQQKPDQPPKLLISQGNTL RPGVPSRFSSSGSGTDFTFTISSLEAE DAATYYCLQSDNLPLTFGQGTKLEIKR TVAAPSVFIFPPDIQMTQSPSSLSASV GDRVTITCRASSGIISYIDWFQQKPGK APKRLIYATFDLASGVPSRFSGSGSGT DYTLTISSLQPEDFATYYCRQVGSYPE TFGQGTKLEIKR |
| 244 | DVD1656H | AB273VH | AB271VH | EVQLVQSGAEVKKPGSSVKVSCKASGY TFTDYEIHWVRQAPGQGLEWMGVNDPE SGGTFYNQKFDGRVTLTADESTSTAYM ELSSLRSEDTAVYYCTRYSKWDSFDGM DYWGQGTTVTVSSASTKGPSVFPLAPE VQLQESGPGLVKPSETLSLTCTVSGFS LSDYGVSWIRQPPGKGLEWLGLIWGGG DTYYNSPLKSRLTISKDNSKQVSLKL SSVTAADTAVYYCAKQRTLWGYDLYGM DYWGQGTLVTVSS |

TABLE 62-continued

| SEQ ID NO | DVD Variable Domain Name | Outer Variable Domain Name | Inner Variable Domain Name | Sequence 123456789012345678901234567 89012345 |
|---|---|---|---|---|
| 245 | DVD1656L | AB273VL | AB271VL | DIQMTQSPSSLSASVGDRVTITCRASS GIISYIDWFQQKPGKAPKRLIYATFDL ASGVPSRFSGSGSGTDYTLTISSLQPE DFATYYCRQVGSYPETFGQGTKLEIKR TVAAPSVFIFPPDTVVTQSPAFLSVTP GEKVTITCITSTDIDVDMNWYQQKPDQ PPKLLISQGNTLRPGVPSRFSSSGSGT DFTFTISSLEAEDAATYYCLQSDNLPL TFGQGTKLEIKR |

Example 2.50

Generation of IL-1β (Seq. 5) and IL-17 (seq. 1) DVD-Igs With Linker Set 4

TABLE 63

| SEQ ID NO | DVD Variable Domain Name | Outer Variable Domain Name | Inner Variable Domain Name | Sequence 12345678901234567890123456 78 9012345 |
|---|---|---|---|---|
| 246 | DVD1657H | AB272VH | AB273VH | EVQLVESGGGLVQPGGSLRLSCAVSGFT LSDYGVSWIRQAPGKGLEWLGLIWGGGD TYYNSPLKSRLTISKDNSKSTVYLQMNS LRAEDTAVYYCAKQRTLWGYDLYGMDYW GQGTLVTVSSASTKGPSVFPLAPEVQLV QSGAEVKKPGSSVKVSCKASGYTFTDYE IHWVRQAPGQGLEWMGVNDPESGGTFYN QKFDGRVTLTADESTSTAYMELSSLRSE DTAVYYCTRYSKWDSFDGMDYWGQGTTV TVSS |
| 247 | DVD1657L | AB272VL | AB273VL | ETTVTQSPSSLSASVGDRVTITCITSTD IDVDMNWYQQKPGKPPKLLISQGNTLRP GVPSRFSSSGSGTDFTFTISSLQPEDFA TYYCLQSDNLPLTFGQGTKLEIKRTVAA PSVFIFPPDIQMTQSPSSLSASVGDRVT ITCRASSGIISYIDWFQQKPGKAPKRLI YATFDLASGVPSRFSGSGSGTDYTLTIS SLQPEDFATYYCRQVGSYPETFGQGTKL EIKR |
| 248 | DVD1658H | AB273VH | AB272VH | EVQLVQSGAEVKKPGSSVKVSCKASGYT FTDYEIHWVRQAPGQGLEWMGVNDPESG GTFYNQKFDGRVTLTADESTSTAYMELS SLRSEDTAVYYCTRYSKWDSFDGMDYWG QGTTVTVSSASTKGPSVFPLAPEVQLVE SGGGLVQPGGSLRLSCAVSGFTLSDYGV SWIRQAPGKGLEWLGLIWGGGDTYYNSP LKSRLTISKDNSKSTVYLQMNSLRAEDT AVYYCAKQRTLWGYDLYGMDYWGQGTLV TVSS |
| 249 | DVD1658L | AB273VL | AB272VL | DIQMTQSPSSLSASVGDRVTITCRASSG IISYIDWFQQKPGKAPKRLIYATFDLAS GVPSRFSGSGSGTDYTLTISSLQPEDFA TYYCRQVGSYPETFGQGTKLEIKRTVAA PSVFIFPPETTVTQSPSSLSASVGDRVT ITCITSTDIDVDMNWYQQKPGKPPKLLI SQGNTLRPGVPSRFSSSGSGTDFTFTIS SLQPEDFATYYCLQSDNLPLTFGQGTKL EIKR |

Example 2.51

Generation of IL-1β (Seq. 1) and IL-17 (Seq. 2) DVD-Igs with Linker Set 4

TABLE 64

| SEQ ID NO | DVD Variable Domain Name | Outer Variable Domain Name | Inner Variable Domain Name | Sequence 123456789012345678901234567 89012345 |
|---|---|---|---|---|
| 250 | DVD1659H | AB268VH | AB274VH | EVQLVESGGGVVQPGRSLRLSCSASGF IFSRYDMSWVRQAPGKGLEWVAYISHG GAGTYYPDSVKGRFTISRDNSKNTLFL QMDSLRPEDTGVYFCARGGVTKGYFDV WGQGTPVTVSSASTKGPSVFPLAPEVQ LVQSGAEVKKPGSSVKVSCKASGGSFG GYGIGWVRQAPGQGLEWMGGITPFFGF ADYAQKFQGRVTITADESTTTAYMELS GLTSDDTAVYYCARDPNEFWNGYYSTH DFDSWGQGTTVTVSS |
| 251 | DVD1659L | AB268VL | AB274VL | DIQMTQSPSSLSASVGDRVTITCRASG NIHNYLTWYQQTPGKAPKLLIYNAKTL ADGVPSRFSGSGSGTDYTFTISSLQPE DIATYYCQHFWSIPYTFGQGTKLQITR TVAAPSVFIFPPEIVLTQSPDFQSVTP KEKVTITCRASQDIGSELHWYQQKPDQ PPKLLIKYASHSTSGVPSRFSGSGSGT DFTLTINGLEAEDAGTYYCHQTDSLPY TFGPGTKVDIKR |
| 252 | DVD1660H | AB274VH | AB268VH | EVQLVQSGAEVKKPGSSVKVSCKASGG SFGGYGIGWVRQAPGQGLEWMGGITPF FGFADYAQKFQGRVTITADESTTTAYM ELSGLTSDDTAVYYCARDPNEFWNGYY STHDFDSWGQGTTVTVSSASTKGPSVF PLAPEVQLVESGGGVVQPGRSLRLSCS ASGFIFSRYDMSWVRQAPGKGLEWVAY ISHGGAGTYYPDSVKGRFTISRDNSKN TLFLQMDSLRPEDTGVYFCARGGVTKG YFDVWGQGTPVTVSS |
| 253 | DVD1660L | AB274VL | AB268VL | EIVLTQSPDFQSVTPKEKVTITCRASQ DIGSELHWYQQKPDQPPKLLIKYASHS TSGVPSRFSGSGSGTDFTLTINGLEAE DAGTYYCHQTDSLPYTFGPGTKVDIKR TVAAPSVFIFPPDIQMTQSPSSLSASV GDRVTITCRASGNIHNYLTWYQQTPGK APKLLIYNAKTLADGVPSRFSGSGSGT DYTFTISSLQPEDIATYYCQHFWSIPY TFGQGTKLQITR |

Example 2.52

Generation of IL-1β (Seq. 2) and IL-17 (Seq. 2) DVD-Igs with Linker Set 4

TABLE 65

| SEQ ID NO | DVD Variable Domain Name | Outer Variable Domain Name | Inner Variable Domain Name | Sequence 123456789012345678901234567 89012345 |
|---|---|---|---|---|
| 254 | DVD1661H | AB269VH | AB274VH | EVQLVESGGGVVQPGRSLRLSCSASGF IFSRYDMSWVRQAPGKGLEWVAYISHG GAGTYYPDSVKGRFTISRDNSKNTLFL QMDSLRAEDTAVYYCARGGVYKGYFDV WGQGTPVTVSSASTKGPSVFPLAPEVQ LVQSGAEVKKPGSSVKVSCKASGGSFG GYGIGWVRQAPGQGLEWMGGITPFFGF ADYAQKFQGRVTITADESTTTAYMELS GLTSDDTAVYYCARDPNEFWNGYYSTH DFDSWGQGTTVTVSS |
| 255 | DVD1661L | AB269VL | AB274VL | DIQMTQSPSSLSASVGDRVTITCRASG NIHNYLTWYQQTPGKAPKLLIYNAKTL |

TABLE 65-continued

| SEQ ID NO | DVD Variable Domain Name | Outer Variable Domain Name | Inner Variable Domain Name | Sequence 123456789012345678901234567 89012345 |
|---|---|---|---|---|
| | | | | ADGVPSRFSGSGSGTDYTFTISSLQPE DIATYYCQHFWSIPYTFGQGTKLQITR TVAAPSVFIFPPEIVLTQSPDFQSVTP KEKVTITCRASQDIGSELHWYQQKPDQ PPKLLIKYASHSTSGVPSRFSGSGSGT DFTLTINGLEAEDAGTYYCHQTDSLPY TFGPGTKVDIKR |
| 256 | DVD1662H | AB274VH | AB269VH | EVQLVQSGAEVKKPGSSVKVSCKASGG SFGGYGIGWVRQAPGQGLEWMGGITPF FGFADYAQKFQGRVTITADESTTTAYM ELSGLTSDDTAVYYCARDPNEFWNGYY STHDFDSWGQGTTVTVSSASTKGPSVF PLAPEVQLVESGGGVVQPGRSLRLSCS ASGFIFSRYDMSWVRQAPGKGLEWVAY ISHGGAGTYYPDSVKGRFTISRDNSKN TLFLQMDSLRAEDTAVYYCARGGVYKG YFDVWGQGTPVTVSS |
| 257 | DVD1662L | AB274VL | AB269VL | EIVLTQSPDFQSVTPKEKVTITCRASQ DIGSELHWYQQKPDQPPKLLIKYASHS TSGVPSRFSGSGSGTDFTLTINGLEAE DAGTYYCHQTDSLPYTFGPGTKVDIKR TVAAPSVFIFPPDIQMTQSPSSLSASV GDRVTITCRASGNIHNYLTWYQQTPGK APKLLIYNAKTLADGVPSRFSGSGSGT DYTFTISSLQPEDIATYYCQHFWSIPY TFGQGTKLQITR |

Example 2.53

Generation of IL-1β (Seq. 3) and IL-17 (Seq. 2) DVD-Igs with Linker Set 4

TABLE 66

| SEQ ID NO | DVD Variable Domain Name | Outer Variable Domain Name | Inner Variable Domain Name | Sequence 123456789012345678901234567 89012345 |
|---|---|---|---|---|
| 258 | DVD1663H | AB270VH | AB274VH | EVQLQESGPGLVKPSETLSLTCT VSGFSLSDYGVSWIRQPPGKGLE WLGLIWGGGDTYYNSPLKSRLTI SKDNSKSQVSLKLSSVTAADTAV YYCAKQRTLWGYDLYGMDYWGQG TLVTVSSASTKGPSVFPLAPEVQ LVQSGAEVKKPGSSVKVSCKASG GSFGGYGIGWVRQAPGQGLEWMG GITPFFGFADYAQKFQGRVTITA DESTTTAYMELSGLTSDDTAVYY CARDPNEFWNGYYSTHDFDSWGQ GTTVTVSS |
| 259 | DVD1663L | AB270VL | AB274VL | DTQVTQSPSSLSASVGDRVTITC ITSTDIDVDMNWYQQKPGKPPKL LISQGNTLRPGVPSRFSSSGSGT DFTFTISSLQPEDFATYYCLQSD NLPLTFGQGTKLEIKRTVAAPSV FIFPPEIVLTQSPDFQSVTPKEK VTITCRASQDIGSELHWYQQKPD QPPKLLIKYASHSTSGVPSRFSG SGSGTDFTLTINGLEAEDAGTYY CHQTDSLPYTFGPGTKVDIKR |

TABLE 66-continued

| SEQ ID NO | DVD Variable Domain Name | Outer Variable Domain Name | Inner Variable Domain Name | Sequence 123456789012345678901234567890123456789012345 |
|---|---|---|---|---|
| 260 | DVD1664H | AB274VH | AB270VH | EVQLVQSGAEVKKPGSSVKVSCKASGGSFGGYGIGWVRQAPGQGLEWMGGITPFFGFADYAQKFQGRVTITADESTTTAYMELSGLTSDDTAVYYCARDPNEFWNGYYSTHDFDSWGQGTTVTVSSASTKGPSVFPLAPEVQLQESGPGLVKPSETLSLTCTVSGFSLSDYGVSWIRQPPGKGLEWLGLIWGGGDTYYNSPLKSRLTISKDNSKSQVSLKLSSVTAADTAVYYCAKQRTLWGYDLYGMDYWGQGTLVTVSS |
| 261 | DVD1664L | AB274VL | AB270VL | EIVLTQSPDFQSVTPKEKVTITCRASQDIGSELHWYQQKPDQPPKLLIKYASHSTSGVPSRFSGSGSGTDFTLTINGLEAEDAGTYYCHQTDSLPYTFGPGTKVDIKRTVAAPSVFIFPPDTQVTQSPSSLSASVGDRVTITCITSTDIDVDMNWYQQKPGKPPKLLISQGNTLRPGVPSRFSSSGSGTDFTFTISSLQPEDFATYYCLQSDNLPLTFGQGTKLEIKR |

Example 2.54

Generation of IL-1β (Seq. 4) and IL-17 (Seq. 2) DVD-Igs with Linker Set 4

TABLE 67

| SEQ ID NO | DVD Variable Domain Name | Outer Variable Domain Name | Inner Variable Domain Name | Sequence 123456789012345678901234567890123456789012345 |
|---|---|---|---|---|
| 262 | DVD1665H | AB271VH | AB274VH | EVQLQESGPGLVKPSETLSLTCTVSGFSLSDYGVSWIRQPPGKGLEWLGLIWGGGDTYYNSPLKSRLTISKDNSKSQVSLKLSSVTAADTAVYYCAKQRTLWGYDLYGMDYWGQGTLVTVSSASTKGPSVFPLAPEVQLVQSGAEVKKPGSSVKVSCKASGGSFGGYGIGWVRQAPGQGLEWMGGITPFFGFADYAQKFQGRVTITADESTTTAYMELSGLTSDDTAVYYCARDPNEFWNGYYSTHDFDSWGQGTTVTVSS |
| 263 | DVD1665L | AB271VL | AB274VL | DTVVTQSPAFLSVTPGEKVTITCITSTDIDVDMNWYQQKPDQPPKLLISQGNTLRPGVPSRFSSSGSGTDFTFTISSLEAEDAATYYCLQSDNLPLTFGQGTKLEIKRTVAAPSVFIFPPEIVLTQSPDFQSVTPKEKVTITCRASQDIGSELHWYQQKPDQPPKLLIKYASHSTSGVPSRFSGSGSGTDFTLTINGLEAEDAGTYYCHQTDSLPYTFGPGTKVDIKR |
| 264 | DVD1666H | AB274VH | AB271VH | EVQLVQSGAEVKKPGSSVKVSCKASGGSFGGYGIGWVRQAPGQGLEWMGGITPFFGFADYAQKFQGRVTITADESTTTAYMELSGLTSDDTAVYYCARDPNEFWNGYYSTHDFDSWGQGTTVTVSSASTKGPSVFPLAPEVQLQESGPGLVKPSETLSLTCTVSGFSLSDYGVSWIRQPPGKGLEWLGLIWGGGDTYYNSPLKSRLTISKDNSKSQVSLKLSSVTAADTAVYYCAKQRTLWGYDLYGMDYWGQGTLVTVSS |

TABLE 67-continued

| SEQ ID NO | DVD Variable Domain Name | Outer Variable Domain Name | Inner Variable Domain Name | Sequence 1234567890123456789012345678901234567 89012345 |
|---|---|---|---|---|
| 265 | DVD1666L | AB274VL | AB271VL | EIVLTQSPDFQSVTPKEKVTITCRASQDIGSELHWYQQKPDQPPKLLIKYASHSTSGVPSRFSGSGSGTDFTLTINGLEAEDAGTYYCHQTDSLPYTFGPGTKVDIKRTVAAPSVFIFPPDTVVTQSPAFLSVTPGEKVTITCITSTDIDVDMNWYQQKPDQPPKLLISQGNTLRPGVPSRFSSSGSGTDFTFTISSLEAEDAATYYCLQSDNLPLTFGQGTKLEIKR |

Example 2.55

Generation of IL-1β (Seq. 5) and IL-17 (Seq. 2) DVD-Igs with Linker Set 4

TABLE 68

| SEQ ID NO | DVD Variable Domain Name | Outer Variable Domain Name | Inner Variable Domain Name | Sequence 12345678901234567890123456789012345 |
|---|---|---|---|---|
| 266 | DVD1667H | AB272VH | AB274VH | EVQLVESGGGLVQPGGSLRLSCAVSGFTLSDYGVSWIRQAPGKGLEWLGLIWGGGDTYYNSPLKSRLTISKDNSKSTVYLQMNSLRAEDTAVYYCAKQRTLWGYDLYGMDYWGQGTLVTVSSASTKGPSVFPLAPEVQLVQSGAEVKKPGSSVKVSCKASGGSFGGYGIGWVRQAPGQGLEWMGGITPFFGFADYAQKFQGRVTITADESTTTAYMELSGLTSDDTAVYYCARDPNEFWNGYYSTHDFDSWGQGTTVTVSS |
| 267 | DVD1667L | AB272VL | AB274VL | ETTVTQSPSSLSASVGDRVTITCITSTDIDVDMNWYQQKPGKPPKLLISQGNTLRPGVPSRFSSSGSGTDFTFTISSLQPEDFATYYCLQSDNLPLTFGQGTKLEIKRTVAAPSVFIFPPEIVLTQSPDFQSVTPKEKVTITCRASQDIGSELHWYQQKPDQPPKLLIKYASHSTSGVPSRFSGSGSGTDFTLTINGLEAEDAGTYYCHQTDSLPYTFGPGTKVDIKR |
| 268 | DVD1668H | AB274VH | AB272VH | EVQLVQSGAEVKKPGSSVKVSCKASGGSFGGYGIGWVRQAPGQGLEWMGGITPFFGFADYAQKFQGRVTITADESTTTAYMELSGLTSDDTAVYYCARDPNEFWNGYYSTHDFDSWGQGTTVTVSSASTKGPSVFPLAPEVQLVESGGGLVQPGGSLRLSCAVSGFTLSDYGVSWIRQAPGKGLEWLGLIWGGGDTYYNSPLKSRLTISKDNSKSTVYLQMNSLRAEDTAVYYCAKQRTLWGYDLYGMDYWGQGTLVTVSS |
| 269 | DVD1668L | AB274VL | AB272VL | EIVLTQSPDFQSVTPKEKVTITCRASQDIGSELHWYQQKPDQPPKLLIKYASHSTSGVPSRFSGSGSGTDFTLTINGLEAEDAGTYYCHQTDSLPYTFGPGTKVDIKRTVAAPSVFIFPPETTVTQSPSSLSASVGDRVTITCITSTDIDVDMNWYQQKPGKPPKLLISQGNTLRPGVPSRFSSSGSGTDFTFTISSLQPEDFATYYCLQSDNLPLTFGQGTKLEIKR |

Example 2.56

Generation of IL-1β (Seq. 1) and IL-17 (Seq. 3) DVD-Igs with Linker Set 4

TABLE 69

| SEQ ID NO | DVD Variable Domain Name | Outer Variable Domain Name | Inner Variable Domain Name | Sequence 123456789012345678901234567890123456789012345 |
|---|---|---|---|---|
| 270 | DVD1669H | AB268VH | AB275VH | EVQLVESGGGVVQPGRSLRLSCSASGFIFSRYDMSWVRQAPGKGLEWVAYISHGGAGTYYPDSVKGRFTISRDNSKNTLFLQMDSLRPEDTGVYFCARGGVTKGYFDVWGQGTPVTVSSASTKGPSVFPLAPEVQLVQSGAEVKKPGESVKISCKASGGSFRSYGISWVRQAPGQGLEWMGGITHFFGITDYAQKFQGRVTITADESTTTAYMELSGLTSDDTAVYYCAREPNDFWNGYYDTHDFDSWGQGTTVTVSS |
| 271 | DVD1669L | AB268VL | AB275VL | DIQMTQSPSSLSASVGDRVTITCRASGNIHNYLTWYQQTPGKAPKLLIYNAKTLADGVPSRFSGSGSGTDYTFTISSLQPEDIATYYCQHFWSIPYTFGQGTKLQITRTVAAPSVFIFPPEIVLTQSPDFQSVTPKEKVTITCRASQNIGSELHWYQQKPDQSPKLLIKYASHSISGVPSRFSGSGSGTDFTLTINGLEAEDAATYYCHQSDTLPHTFGQGTKVDIKR |
| 272 | DVD1670H | AB275VH | AB268VH | EVQLVQSGAEVKKPGESVKISCKASGGSFRSYGISWVRQAPGQGLEWMGGITHFFGITDYAQKFQGRVTITADESTTTAYMELSGLTSDDTAVYYCAREPNDFWNGYYDTHDFDSWGQGTTVTVSSASTKGPSVFPLAPEVQLVESGGGVVQPGRSLRLSCSASGFIFSRYDMSWVRQAPGKGLEWVAYISHGGAGTYYPDSVKGRFTISRDNSKNTLFLQMDSLRPEDTGVYFCARGGVTKGYFDVWGQGTPVTVSS |
| 273 | DVD1670L | AB275VL | AB268VL | EIVLTQSPDFQSVTPKEKVTITCRASQNIGSELHWYQQKPDQSPKLLIKYASHSISGVPSRFSGSGSGTDFTLTINGLEAEDAATYYCHQSDTLPHTFGQGTKVDIKRTVAAPSVFIFPPDIQMTQSPSSLSASVGDRVTITCRASGNIHNYLTWYQQTPGKAPKLLIYNAKTLADGVPSRFSGSGSGTDYTFTISSLQPEDIATYYCQHFWSIPYTFGQGTKLQITR |

Example 2.57

Generation of IL-1β (Seq. 2) and IL-17 (Seq. 3) DVD-Igs with Linker Set 4

TABLE 70

| SEQ ID NO | DVD Variable Domain Name | Outer Variable Domain Name | Inner Variable Domain Name | Sequence 1234567890123456789012345678901234567890 |
|---|---|---|---|---|
| 274 | DVD1671H | AB269VH | AB275VH | EVQLVESGGGVVQPGRSLRLSCSASGFIFSRYDMSWVRQAPGKGLEWVAYISHGGAGTYYPDSVKGRFTISRDNSKNTLFLQMDSLRAEDTAVYYCARGGVYKGYFDVWGQGTPVTVSSASTKGPSVFPLAPEVQLVQSGAEVKKPGESVKISCKASGGSFRSYGISWVRQAPGQGLEWMGGITHFFGITDYAQKFQGRVTITADESTTTAYMELSGLTSDDTAVYYCAREPNDFWNGYYDTHDFDSWGQGTTVTVSS |
| 275 | DVD1671L | AB269VL | AB275VL | DIQMTQSPSSLSASVGDRVTITCRASGNIHNYLTWYQQTPGKAPKLLIYNAKTLAD |

TABLE 70-continued

| SEQ ID NO | DVD Variable Domain Name | Outer Variable Domain Name | Inner Variable Domain Name | Sequence 123456789012345678901234567890123456789012345 |
|---|---|---|---|---|
| | | | | GVPSRFSGSGSGTDYTFTISSLQPEDIA TYYCQHFWSIPYTFGQGTKLQITRTVAA PSVFIFPPEIVLTQSPDFQSVTPKEKVT ITCRASQNIGSELHWYQQKPDQSPKLLI KYASHSISGVPSRFSGSGSGTDFTLTIN GLEAEDAATYYCHQSDTLPHTFGQGTKV DIKR |
| 276 | DVD1672H | AB275VH | AB269VH | EVQLVQSGAEVKKPGESVKISCKASGGS FRSYGISWVRQAPGQGLEWMGGITHFFG ITDYAQKFQGRVTITADESTTTAYMELS GLTSDDTAVYYCAREPNDFWNGYYDTHD FDSWGQGTTVTVSSASTKGPSVFPLAPE VQLVESGGGVVQPGRSLRLSCSASGFIF SRYDMSWVRQAPGKGLEWVAYISHGGAG TYYPDSVKGRFTISRDNSKNTLFLQMDS LRAEDTAVYYCARGGVYKGYFDVWGQGT PVTVSS |
| 277 | DVD1672L | AB275VL | AB269VL | EIVLTQSPDFQSVTPKEKVTITCRASQN IGSELHWYQQKPDQSPKLLIKYASHSIS GVPSRFSGSGSGTDFTLTINGLEAEDAA TYYCHQSDTLPHTFGQGTKVDIKRTVAA PSVFIFPPDIQMTQSPSSLSASVGDRVT ITCRASGNIHNYLTWYQQTPGKAPKLLI YNAKTLADGVPSRFSGSGSGTDYTFTIS SLQPEDIATYYCQHFWSIPYTFGQGTKL QITR |

Example 2.58

Generation of IL-1β (Seq. 3) and IL-17 (Seq. 3) DVD-Igs with Linker Set 4

TABLE 71

| SEQ ID NO | DVD Variable Domain Name | Outer Variable Domain Name | Inner Variable Domain Name | Sequence 123456789012345678901234567890123456789012345 |
|---|---|---|---|---|
| 278 | DVD1673H | AB270VH | AB275VH | EVQLQESGPGLVKPSETLSLTCTVSGFS LSDYGVSWIRQPPGKGLEWLGLIWGGGD TYYNSPLKSRLTISKDNSKSQVSLKLSS VTAADTAVYYCAKQRTLWGYDLYGMDYW GQGTLVTVSSASTKGPSVFPLAPEVQLV QSGAEVKKPGESVKISCKASGGSFRSYG ISWVRQAPGQGLEWMGGITHFFGITDYA QKFQGRVTITADESTTTAYMELSGLTSD DTAVYYCAREPNDFWNGYYDTHDFDSWG QGTTVTVSS |
| 279 | DVD1673L | AB270VL | AB275VL | DTQVTQSPSSLSASVGDRVTITCITSTD IDVDMNWYQQKPGKPPKLLISQGNTLRP GVPSRFSSSGSGTDFTFTISSLQPEDFA TYYCLQSDNLPLTFGQGTKLEIKRTVAA PSVFIFPPEIVLTQSPDFQSVTPKEKVT ITCRASQNIGSELHWYQQKPDQSPKLLI KYASHSISGVPSRFSGSGSGTDFTLTIN GLEAEDAATYYCHQSDTLPHTFGQGTKV DIKR |
| 280 | DVD1674H | AB275VH | AB270VH | EVQLVQSGAEVKKPGESVKISCKASGGS FRSYGISWVRQAPGQGLEWMGGITHFFG ITDYAQKFQGRVTITADESTTTAYMELS GLTSDDTAVYYCAREPNDFWNGYYDTHD FDSWGQGTTVTVSSASTKGPSVFPLAPE VQLQESGPGLVKPSETLSLTCTVSGFSL SDYGVSWIRQPPGKGLEWLGLIWGGGDT YYNSPLKSRLTISKDNSKSQVSLKLSSV TAADTAVYYCAKQRTLWGYDLYGMDYWG QGTLVTVSS |

TABLE 71-continued

| SEQ ID NO | DVD Variable Domain Name | Outer Variable Domain Name | Inner Variable Domain Name | Sequence 123456789012345678901234567890123456789012345 |
|---|---|---|---|---|
| 281 | DVD1674L | AB275VL | AB270VL | EIVLTQSPDFQSVTPKEKVTITCRASQN IGSELHWYQQKPDQSPKLLIKYASHSIS GVPSRFSGSGSGTDFTLTINGLEAEDAA TYYCHQSDTLPHTFGQGTKVDIKRTVAA PSVFIFPPDTQVTQSPSSLSASVGDRVT ITCITSTDIDVDMNWYQQKPGKPPKLLI SQGNTLRPGVPSRFSSSGSGTDFTFTIS SLQPEDFATYYCLQSDNLPLTFGQGTKL EIKR |

Example 2.59

Generation of IL-1β (Seq. 4) and IL-17 (Seq. 3) DVD-Igs with Linker Set 4

TABLE 72

| SEQ ID NO | DVD Variable Domain Name | Outer Variable Domain Name | Inner Variable Domain Name | Sequence 123456789012345678901234567890123456789012345 |
|---|---|---|---|---|
| 282 | DVD1675H | AB271VH | AB275VH | EVQLQESGPGLVKPSETLSLTCTVSGFS LSDYGVSWIRQPPGKGLEWLGLIWGGGD TYYNSPLKSRLTISKDNSKSQVSLKLSS VTAADTAVYYCAKQRTLWGYDLYGMDYW GQGTLVTVSSASTKGPSVFPLAPEVQLV QSGAEVKKPGESVKISCKASGGSFRSYG ISWVRQAPGQGLEWMGGITHFFGITDYA QKFQGRVTITADESTTTAYMELSGLTSD DTAVYYCAREPNDFWNGYYDTHDFDSWG QGTTVTVSS |
| 283 | DVD1675L | AB271VL | AB275VL | DTVVTQSPAFLSVTPGEKVTITCITSTD IDVDMNWYQQKPDQPPKLLISQGNTLRP GVPSRFSSSGSGTDFTFTISSLEAEDAA TYYCLQSDNLPLTFGQGTKLEIKRTVAA PSVFIFPPEIVLTQSPDFQSVTPKEKVT ITCRASQNIGSELHWYQQKPDQSPKLLI KYASHSISGVPSRFSGSGSGTDFTLTIN GLEAEDAATYYCHQSDTLPHTFGQGTKV DIKR |
| 284 | DVD1676H | AB275VH | AB271VH | EVQLVQSGAEVKKPGESVKISCKASGGS FRSYGISWVRQAPGQGLEWMGGITHFFG ITDYAQKFQGRVTITADESTTTAYMELS GLTSDDTAVYYCAREPNDFWNGYYDTHD FDSWGQGTTVTVSSASTKGPSVFPLAPE VQLQESGPGLVKPSETLSLTCTVSGFSL SDYGVSWIRQPPGKGLEWLGLIWGGGDT YYNSPLKSRLTISKDNSKSQVSLKLSSV TAADTAVYYCAKQRTLWGYDLYGMDYWG QGTLVTVSS |
| 285 | DVD1676L | AB275VL | AB271VL | EIVLTQSPDFQSVTPKEKVTITCRASQN IGSELHWYQQKPDQSPKLLIKYASHSIS GVPSRFSGSGSGTDFTLTINGLEAEDAA TYYCHQSDTLPHTFGQGTKVDIKRTVAA PSVFIFPPDTVVTQSPAFLSVTPGEKVT ITCITSTDIDVDMNWYQQKPDQPPKLLI SQGNTLRPGVPSRFSSSGSGTDFTFTIS SLEAEDAATYYCLQSDNLPLTFGQGTKL EIKR |

Example 2.60

Generation of IL-1β (Seq. 5) and IL-17 (Seq. 3) DVD-Igs with Linker Set 4

TABLE 73

| SEQ ID NO | DVD Variable Domain Name | Outer Variable Domain Name | Inner Variable Domain Name | Sequence 123456789012345678901234567890123456789012345 |
|---|---|---|---|---|
| 286 | DVD1677H | AB272VH | AB275VH | EVQLVESGGGLVQPGGSLRLSCAVSGFTLSDYGVSWIRQAPGKGLEWLGLIWGGGDTYYNSPLKSRLTISKDNSKSTVYLQMNSLRAEDTAVYYCAKQRTLWGYDLYGMDYWGQGTLVTVSSASTKGPSVFPLAPEVQLVQSGAEVKKPGESVKISCKASGGSFRSYGISWVRQAPGQGLEWMGGITHFFGITDYAQKFQGRVTITADESTTTAYMELSGLTSDDTAVYYCAREPNDFWNGYYDTHDFDSWGQGTTVTVSS |
| 287 | DVD1677L | AB272VL | AB275VL | ETTVTQSPSSLSASVGDRVTITCITSTDIDVDMNWYQQKPGKPPKLLISQGNTLRPGVPSRFSSSGSGTDFTFTISSLQPEDFATYYCLQSDNLPLTFGQGTKLEIKRTVAAPSVFIFPPEIVLTQSPDFQSVTPKEKVTITCRASQNIGSELHWYQQKPDQSPKLLIKYASHSISGVPSRFSGSGSGTDFTLTINGLEAEDAATYYCHQSDTLPHTFGQGTKVDIKR |
| 288 | DVD1678H | AB275VH | AB272VH | EVQLVQSGAEVKKPGESVKISCKASGGSFRSYGISWVRQAPGQGLEWMGGITHFFGITDYAQKFQGRVTITADESTTTAYMELSGLTSDDTAVYYCAREPNDFWNGYYDTHDFDSWGQGTTVTVSSASTKGPSVFPLAPEVQLVESGGGLVQPGGSLRLSCAVSGFTLSDYGVSWIRQAPGKGLEWLGLIWGGGDTYYNSPLKSRLTISKDNSKSTVYLQMNSLRAEDTAVYYCAKQRTLWGYDLYGMDYWGQGTLVTVSS |
| 289 | DVD1678L | AB275VL | AB272VL | EIVLTQSPDFQSVTPKEKVTITCRASQNIGSELHWYQQKPDQSPKLLIKYASHSISGVPSRFSGSGSGTDFTLTINGLEAEDAATYYCHQSDTLPHTFGQGTKVDIKRTVAAPSVFIFPPETTVTQSPSSLSASVGDRVTITCITSTDIDVDMNWYQQKPGKPPKLLISQGNTLRPGVPSRFSSSGSGTDFTFTISSLQPEDFATYYCLQSDNLPLTFGQGTKLEIKR |

Example 2.61

Cloning Vector Sequences Used to Clone Parent Antibody and DVD-Ig Sequences

TABLE 74

| Vector name | SEQ ID NO | Nucleotide sequences 12345678901234567890123456789012345678901234567890 |
|---|---|---|
| V1 | 290 | GCGTCGACCAAGGGCCCATCGGTCTTCCCCCTGGCACCCTCCTCCAAGAGCACCTCTGGGGGCACAGCGGCCCTGGGCTGCCTGGTCAAGGACTACTTCCCCGAACCGGTGACGGTGTCGTGGAACTCAGGCGCCCTGACCAGCGGCGTGCACACCTTCCCGGCTGTCCTACAGTCCTCAGGACTCTACTCCCTCAGCAGCGTGGTGACCGTGCCCTCCAGCAGCTTGGGCACCCAGACCTACATCTGCAACGTGAATCACAAGCCCAGCAACACCAAGGTGGACAAGAAAGTTGAGCCCAAATCTTGTGACAAAACTCACACATGCCCACCGTGCCCAGCACCTGAACTCCTGGGGGGACCGTCAGTCTTCCTCTTCCCCCCAAAACCCAAGGACACCCTCATGATCTCCCGGACCCCTGAGGTCACATGCGTGGTGGTGGACGTGAGCCACGAAGACCCTGAGGTCAAGTTCAACTGGTACGTGGACGGCGTGGAGGTGCATAATGCCAAGACAAAGCCGCGGGAGGAGCAGTACAACAGCACGTACCGTGTGGTCAGCGTCCTCACCGTCCTGCACCAGGACTGGCTGAATGGCAAGGAGTACAAGTGCAAGGTCTCCAACAAAGCCCTCCCAGCCCCCAT |

TABLE 74-continued

| Vector name | SEQ ID NO | Nucleotide sequences |
|---|---|---|
| | | CGAGAAAACCATCTCCAAAGCCAAAGGGCAGCCCCGAGAACCACAG |
| | | GTGTACACCCTGCCCCCATCCCGCGAGGAGATGACCAAGAACCAGG |
| | | TCAGCCTGACCTGCCTGGTCAAAGGCTTCTATCCCAGCGACATCGC |
| | | CGTGGAGTGGGAGAGCAATGGGCAGCCGGAGAACAACTACAAGACC |
| | | ACGCCTCCCGTGCTGGACTCCGACGGCTCCTTCTTCCTCTACAGCA |
| | | AGCTCACCGTGGACAAGAGCAGGTGGCAGCAGGGGAACGTCTTCTC |
| | | ATGCTCCGTGATGCATGAGGCTCTGCACAACCACTACACGCAGAAG |
| | | AGCCTCTCCCTGTCTCCGGGTAAATGAGCGGCCGCTCGAGGCCGGC |
| | | AAGGCCGGATCCCCCGACCTCGACCTCTGGCTAATAAAGGAAATTT |
| | | ATTTTCATTGCAATAGTGTGTTGGAATTTTTTGTGTCTCTCACTCG |
| | | GAAGGACATATGGGAGGGCAAATCATTTGGTCGAGATCCCTCGGAG |
| | | ATCTCTAGCTAGAGGATCGATCCCCGCCCCGGACGAACTAAACCTG |
| | | ACTACGACATCTCTGCCCCTTCTTCGCGGGGCAGTGCATGTAATCC |
| | | CTTCAGTTGGTTGGTACAACTTGCCAACTGGGCCCTGTTCCACATG |
| | | TGACACGGGGGGGACCAAACACAAAGGGGTTCTCTGACTGTAGTT |
| | | GACATCCTTATAAATGGATGTGCACATTTGCCAACACTGAGTGGCT |
| | | TTCATCCTGGAGCAGACTTTGCAGTCTGTGGACTGCAACACAACAT |
| | | TGCCTTTATGTGTAACTCTTGGCTGAAGCTCTTACACCAATGCTGG |
| | | GGGACATGTACCTCCCAGGGGCCCAGGAAGACTACGGGAGGCTACA |
| | | CCAACGTCAATCAGAGGGGCCTGTGTAGCTACCGATAAGCGGACCC |
| | | TCAAGAGGGCATTAGCAATAGTGTTTATAAGGCCCCCTTGTTAACC |
| | | CTAAACGGGTAGCATATGCTTCCCGGGTAGTAGTATATACTATCCA |
| | | GACTAACCCTAATTCAATAGCATATGTTACCCAACGGGAAGCATAT |
| | | GCTATCGAATTAGGGTTAGTAAAAGGGTCCTAAGGAACAGCGATAT |
| | | CTCCCACCCCATGAGCTGTCACGGTTTTATTTACATGGGGTCAGGA |
| | | TTCCACGAGGGTAGTGAACCATTTTAGTCACAAGGGCAGTGGCTGA |
| | | AGATCAAGGAGCGGGCAGTGAACTCTCCTGAATCTTCGCCTGCTTC |
| | | TTCATTCTCCTTCGTTTAGCTAATAGAATAACTGCTGAGTTGTGAA |
| | | CAGTAAGGTGTATGTGAGGTGCTCGAAAACAAGGTTTCAGGTGACG |
| | | CCCCCAGAATAAAATTTGGACGGGGGGTTCAGTGGTGGCATTGTGC |
| | | TATGACACCAATATAACCCTCACAAACCCCTTGGGCAATAAATACT |
| | | AGTGTAGGAATGAAACATTCTGAATATCTTTAACAATAGAAATCCA |
| | | TGGGGTGGGGACAAGCCGTAAAGACTGGATGTCCATCTCACACGAA |
| | | TTTATGCTATGGGCAACACATAATCCTAGTGCAATATGATACTGG |
| | | GGTTATTAAGATGTGTCCCAGGCAGGGACCAAGACAGGTGAACCAT |
| | | GTTGTTACACTCTATTTGTAACAAGGGGAAAGAGAGTGGACGCCGA |
| | | CAGCAGCGGACTCCACTGGTTGTCTCTAACACCCCCGAAAATTAAA |
| | | CGGGGCTCCACGCCAATGGGCCCATAAACAAAGACAAGTGGCCAC |
| | | TCTTTTTTTTGAAATTGTGGAGTGGGGGCACGCGTCAGCCCCCACA |
| | | CGCCGCCCTGCGGTTTTGGACTGTAAAATAAGGGTGTAATAACTTG |
| | | GCTGATTGTAACCCCGCTAACCACTGCGGTCAAACCACTTGCCCAC |
| | | AAAACCACTAATGGCACCCCGGGGAATACCTGCATAAGTAGGTGGG |
| | | CGGGCCAAGATAGGGGCGCGATTGCTGCGATCTGGAGGACAAATTA |
| | | CACACACTTGCGCCTGAGCGCCAAGCACAGGGTTGTTGGTCCTCAT |
| | | ATTCACGAGGTCGCTGAGAGCACGGTGGGCTAATGTTGCCATGGGT |
| | | AGCATATACTACCCAAATATCTGGATAGCATATGCTATCCTAATCT |
| | | ATATCTGGGTAGCATAGGCTATCCTAATCTATATCTGGGTAGCATA |
| | | TGCTATCCTAATCTATATCTGGGTAGTATATGCTATCCTAATTTAT |
| | | ATCTGGGTAGCATAGGCTATCCTAATCTATATCTGGGTAGCATATG |
| | | CTATCCTAATCTATATCTGGGTAGTATATGCTATCCTAATCTGTAT |
| | | CCGGGTAGCATATGCTATCCTAATAGAGATTAGGGTAGTATATGCT |
| | | ATCCTAATTTATATCTGGGTAGCATATACTACCCAAATATCTGGAT |
| | | AGCATATGCTATCCTAATCTATATCTGGGTAGCATATGCTATCCTA |
| | | ATCTATATCTGGGTAGCATAGGCTATCCTAATCTATATCTGGGTAG |
| | | CATATGCTATCCTAATCTATATCTGGGTAGTATATGCTATCCTAAT |
| | | TTATATCTGGGTAGCATAGGCTATCCTAATCTATATCTGGGTAGCA |
| | | TATGCTATCCTAATCTATATCTGGGTAGTATATGCTATCCTAATCT |
| | | GTATCCGGGTAGCATATGCTATCCTCATGATAAGCTGTCAAACATG |
| | | AGAATTTTCTTGAAGACGAAAGGGCCTCGTGATACGCCTATTTTTA |
| | | TAGGTTAATGTCATGATAATAATGGTTTCTTAGACGTCAGGTGGCA |
| | | CTTTTCGGGGAAATGTGCGCGGAACCCCTATTTGTTTATTTTTCTA |
| | | AATACATTCAAATATGTATCCGCTCATGAGACAATAACCCTGATAA |
| | | ATGCTTCAATAATATTGAAAAAGGAAGAGTATGAGTATTCAACATT |
| | | TCCGTGTCGCCCTTATTCCCTTTTTTGCGGCATTTTGCCTTCCTGT |
| | | TTTTGCTCACCCAGAAACGCTGGTGAAAGTAAAAGATGCTGAAGAT |
| | | CAGTTGGGTGCACGAGTGGGTTACATCGAACTGGATCTCAACAGCG |
| | | GTAAGATCCTTGAGAGTTTTCGCCCCGAAGAACGTTTTCCAATGAT |
| | | GAGCACTTTTAAAGTTCTGCTATGTGGCGCGGTATTATCCCGTGTT |
| | | GACGCCGGGCAAGAGCAACTCGGTCGCCGCATACACTATTCTCAGA |
| | | ATGACTTGGTTGAGTACTCACCAGTCACAGAAAAGCATCTTACGGA |
| | | TGGCATGACAGTAAGAGAATTATGCAGTGCTGCCATAACCATGAGT |
| | | GATAACACTGCGGCCAACTTACTTCTGACAACGATCGGAGGACCGA |
| | | AGGAGCTAACCGCTTTTTTGCACAACATGGGGGATCATGTAACTCG |
| | | CCTTGATCGTTGGGAACCGGAGCTGAATGAAGCCATACCAAACGAC |
| | | GAGCGTGACACCACGATGCCTGCAGCAATGGCAACAACGTTGCGCA |
| | | AACTATTAACTGGCGAACTACTTACTCTAGCTTCCCGGCAACAATT |

TABLE 74-continued

| Vector name | SEQ ID NO | Nucleotide sequences |
|---|---|---|
| | | AATAGACTGGATGGAGGCGGATAAAGTTGCAGGACCACTTCTGCGC |
| | | TCGGCCCTTCCGGCTGGCTGGTTATTGCTGATAAATCTGGAGCCG |
| | | GTGAGCGTGGGTCTCGCGGTATCATTGCAGCACTGGGGCCAGATGG |
| | | TAAGCCCTCCCGTATCGTAGTTATCTACACGACGGGGAGTCAGGCA |
| | | ACTATGGATGAACGAAATAGACAGATCGCTGAGATAGGTGCCTCAC |
| | | TGATTAAGCATTGGTAACTGTCAGACCAAGTTTACTCATATATACT |
| | | TTAGATTGATTTAAAACTTCATTTTTAATTTAAAAGGATCTAGGTG |
| | | AAGATCCTTTTTGATAATCTCATGACCAAAATCCCTTAACGTGAGT |
| | | TTTCGTTCCACTGAGCGTCAGACCCCGTAGAAAAGATCAAAGGATC |
| | | TTCTTGAGATCCTTTTTTTCTGCGCGTAATCTGCTGCTTGCAAACA |
| | | AAAAAACCACCGCTACCAGCGGTGGTTTGTTTGCCGGATCAAGAGC |
| | | TACCAACTCTTTTTCCGAAGGTAACTGGCTTCAGCAGAGCGCAGAT |
| | | ACCAAATACTGTTCTTCTAGTGTAGCCGTAGTTAGGCCACCACTTC |
| | | AAGAACTCTGTAGCACCGCCTACATACCTCGCTCTGCTAATCCTGT |
| | | TACCAGTGGCTGCTGCCAGTGGCGATAAGTCGTGTCTTACCGGGTT |
| | | GGACTCAAGACGATAGTTACCGGATAAGGCGCAGCGGTCGGGCTGA |
| | | ACGGGGGGTTCGTGCACACAGCCCAGCTTGGAGCGAACGACCTACA |
| | | CCGAACTGAGATACCTACAGCGTGAGCTATGAGAAAGCGCCACGCT |
| | | TCCCGAAGGGAGAAAGGCGGACAGGTATCCGGTAAGCGGCAGGGTC |
| | | GGAACAGGAGAGCGCACGAGGGAGCTTCCAGGGGGAAACGCCTGGT |
| | | ATCTTTATAGTCCTGTCGGGTTTCGCCACCTCTGACTTGAGCGTCG |
| | | ATTTTTGTGATGCTCGTCAGGGGGCGGAGCCTATGGAAAAACGCC |
| | | AGCAACGCGGCCTTTTTACGGTTCCTGGCCTTTTGCTGGCCTTTTG |
| | | CTCACATGTTCTTTCCTGCGTTATCCCCTGATTCTGTGGATAACCG |
| | | TATTACCGCCTTTGAGTGAGCTGATACCGCTCGCCGCAGCCGAACG |
| | | ACCGAGCGCAGCGAGTCAGTGAGCGAGGAAGCGGAAGAGCGCCCAA |
| | | TACGCAAACCGCCTCTCCCCGCGCGTTGGCCGATTCATTAATGCAG |
| | | CTGGCACGACAGGTTTCCCGACTGGAAAGCGGGCAGTGAGCGCAAC |
| | | GCAATTAATGTGAGTTAGCTCACTCATTAGGCACCCCAGGCTTTAC |
| | | ACTTTATGCTTCCGGCTCGTATGTTGTGTGGAATTGTGAGCGGATA |
| | | ACAATTTCACACAGGAAACAGCTATGACCATGATTACGCCAAGCTC |
| | | TAGCTAGAGGTCGAGTCCCTCCCCAGCAGGCAGAAGTATGCAAAGC |
| | | ATGCATCTCAATTAGTCAGCAACCATAGTCCCGCCCCTAACTCCGC |
| | | CCATCCCGCCCCTAACTCCGCCCAGTTCCGCCCATTCTCCGCCCCA |
| | | TGGCTGACTAATTTTTTTTATTTATGCAGAGGCCGAGGCCGCCTCG |
| | | GCCTCTGAGCTATTCCAGAAGTAGTGAGGAGGCTTTTTTGGAGGCC |
| | | TAGGCTTTTGCAAAAAGCTTTGCAAAGATGGATAAAGTTTTAAACA |
| | | GAGAGGAATCTTTGCAGCTAATGGACCTTCTAGGTCTTGAAAGGAG |
| | | TGGGAATTGGCTCCGGTGCCCGTCAGTGGGCAGAGCGCACATCGCC |
| | | CACAGTCCCCGAGAAGTTGGGGGAGGGGTCGGCAATTGAACCGGT |
| | | GCCTAGAGAAGGTGGCGCGGGGTAAACTGGGAAAGTGATGTCGTGT |
| | | ACTGGCTCCGCCTTTTTCCCGAGGGTGGGGGAGAACCGTATATAAG |
| | | TGCAGTAGTCGCCGTGAACGTTCTTTTTCGCAACGGGTTTGCCGCC |
| | | AGAACACAGGTAAGTGCCGTGTGTGGTTCCCGCGGGCCTGGCCTCT |
| | | TTACGGGTTATGGCCCTTGCGTGCCTTGAATTACTTCCACCTGGCT |
| | | GCAGTACGTGATTCTTGATCCCGAGCTTCGGGTTGGAAGTGGGTGG |
| | | GAGAGTTCGAGGCCTTGCGCTTAAGGAGCCCCTTCGCCTCGTGCTT |
| | | GAGTTGAGGCCTGGCCTGGGCGCTGGGGCCGCCGCGTGCGAATCTG |
| | | GTGGCACCTTCGCGCCTGTCTCGCTGCTTTCGATAAGTCTCTAGCC |
| | | ATTTAAAATTTTTGATGACCTGCTGCGACGCTTTTTTTCTGGCAG |
| | | ATAGTCTTGTAAATGCGGGCCAAGATCTGCACACTGGTATTTCGGT |
| | | TTTTGGGGCCGCGGGCGGCGACGGGGCCCGTGCGTCCCAGCGCACA |
| | | TGTTCGGCGAGGCGGGGCCTGCGAGCGCGGCCACCGAGAATCGGAC |
| | | GGGGGTAGTCTCAAGCTGGCCGGCCTGCTCTGGTGCCTGGCCTCGC |
| | | GCCGCCGTGTATCGCCCCGCCCTGGGCGGCAAGGCTGGCCCGGTCG |
| | | GCACCAGTTGCGTGAGCGGAAAGATGGCCGCTTCCCGGCCCTGCTG |
| | | CAGGGAGCTCAAAATGGAGGACGCGGCGCTCGGGAGAGCGGGCGGG |
| | | TGAGTCACCCACACAAAGGAAAAGGGCCTTTCCGTCCTCAGCCGTC |
| | | GCTTCATGTGACTCCACGGAGTACCGGGCGCCGTCCAGGCACCTCG |
| | | ATTAGTTCTCGAGCTTTTGGAGTACGTCGTCTTTAGGTTGGGGGGA |
| | | GGGGTTTTATGCGATGGAGTTTCCCCACACTGAGTGGGTGGAGACT |
| | | GAAGTTAGGCCAGCTTGGCACTTGATGTAATTCTCCTTGGAATTTG |
| | | CCCTTTTTGAGTTTGGATCTTGGTTCATTCTCAAGCCTCAGACAGT |
| | | GGTTCAAAGTTTTTTTCTTCCATTTCAGGTGTCGTGAGGAATTCTC |
| | | TAGAGATCCCTCGACCTCGAGATCCATTGTGCCCGGGCGCCACCAT |
| | | GGAGTTTGGGCTGAGCTGGCTTTTCTTGTCGCGATTTTAAAAGGT |
| | | GTCCAGTGC |
| V2 | 291 | ACGGTGGCTGCACCATCTGTCTTCATCTTCCCGCCATCTGATGAGC |
| | | AGTTGAAATCTGGAACTGCCTCTGTTGTGTGCCTGCTGAATAACTT |
| | | CTATCCCAGAGAGGCCAAAGTACAGTGGAAGGTGGATAACGCCCTC |
| | | CAATCGGGTAACTCCCAGGAGAGTGTCACAGAGCAGGACAGCAAGG |
| | | ACAGCACCTACAGCCTCAGCAGCACCCTGACGCTGAGCAAAGCAGA |
| | | CTACGAGAAACACAAAGTCTACGCCTGCGAAGTCACCCATCAGGGC |
| | | CTGAGCTCGCCCGTCACAAAGAGCTTCAACAGGGGAGAGTGTTGAG |
| | | CGGCCGCTCGAGGCCGGCAAGGCCGGATCCCCCGACCTCGACCTCT |

TABLE 74-continued

| Vector name | SEQ ID NO | Nucleotide sequences |
|---|---|---|
| | | GGCTAATAAAGGAAATTTATTTTCATTGCAATAGTGTGTTGGAATT |
| | | TTTTGTGTCTCTCACTCGGAAGGACATATGGGAGGGCAAATCATTT |
| | | GGTCGAGATCCCTCGGAGATCTCTAGCTAGAGGATCGATCCCCGCC |
| | | CCGGACGAACTAAACCTGACTACGACATCTCTGCCCCTTCTTCGCG |
| | | GGGCAGTGCATGTAATCCCTTCAGTTGGTTGGTACAACTTGCCAAC |
| | | TGGGCCCTGTTCCACATGTGACACGGGGGGGGACCAAACACAAAGG |
| | | GGTTCTCTGACTGTAGTTGACATCCTTATAAATGGATGTGCACATT |
| | | TGCCAACACTGAGTGGCTTTCATCCTGGAGCAGACTTTGCAGTCTG |
| | | TGGACTGCAACACAACATTGCCTTTATGTGTAACTCTTGGCTGAAG |
| | | CTCTTACACCAATGCTGGGGGACATGTACCTCCCAGGGGCCCAGGA |
| | | AGACTACGGGAGGCTACACCAACGTCAATCAGAGGGGCCTGTGTAG |
| | | CTACCGATAAGCGGACCCTCAAGAGGGCATTAGCAATAGTGTTTAT |
| | | AAGGCCCCCTTGTTAACCCTAAACGGGTAGCATATGCTTCCCGGGT |
| | | AGTAGTATATACTATCCAGACTAACCCTAATTCAATAGCATATGTT |
| | | ACCCAACGGGAAGCATATGCTATCGAATTAGGGTTAGTAAAAGGGT |
| | | CCTAAGGAACAGCGATATCTCCCACCCCATGAGCTGTCACGGTTTT |
| | | ATTTACATGGGGTCAGGATTCCACGAGGGTAGTGAACCATTTTAGT |
| | | CACAAGGGCAGTGGCTGAAGATCAAGGAGCGGGCAGTGAACTCTCC |
| | | TGAATCTTCGCCTGCTTCTTCATTCTCCTTCGTTTAGCTAATAGAA |
| | | TAACTGCTGAGTTGTGAACAGTAAGGTGTATGTGAGGTGCTCGAAA |
| | | ACAAGGTTTCAGGTGACGCCCCCAGAATAAAATTTGGACGGGGGGT |
| | | TCAGTGGTGGCATTGTGCTATGACACCAATATAACCCTCACAAACC |
| | | CCTTGGGCAATAAATACTAGTGTAGGAATGAAACATTCTGAATATC |
| | | TTTAACAATAGAAATCCATGGGGTGGGACAAGCCGTAAAGACTGG |
| | | ATGTCCATCTCACACGAATTTATGGCTATGGGCAACACATAATCCT |
| | | AGTGCAATATGATACTGGGGTTATTAAGATGTGTCCCAGGCAGGGA |
| | | CCAAGACAGGTGAACCATGTTGTTACACTCTATTTGTAACAAGGGG |
| | | AAAGAGAGTGGACGCCGACAGCAGCGGACTCCACTGGTTGTCTCTA |
| | | ACACCCCCGAAAATTAAACGGGGCTCCACGCCAATGGGGCCCATAA |
| | | ACAAAGACAAGTGGCCACTCTTTTTTTTGAAATTGTGGAGTGGGGG |
| | | CACGCGTCAGCCCCCACACGCCGCCCTGCGGTTTTGGACTGTAAAA |
| | | TAAGGGTGTAATAACTTGGCTGATTGTAACCCCGCTAACCACTGCG |
| | | GTCAAACCACTTGCCCACAAAACCACTAATGGCACCCCGGGGAATA |
| | | CCTGCATAAGTAGGTGGGCGGGCCAAGATAGGGGCGCGATTGCTGC |
| | | GATCTGGAGGACAAATTACACACACTTGCGCCTGAGCGCCAAGCAC |
| | | AGGGTTGTTGGTCCTCATATTCACGAGGTCGCTGAGAGCACGGTGG |
| | | GCTAATGTTGCCATGGGTAGCATATACTACCCAAATATCTGGATAG |
| | | CATATGCTATCCTAATCTATATCTGGGTAGCATAGGCTATCCTAAT |
| | | CTATATCTGGGTAGCATATGCTATCCTAATCTATATCTGGGTAGTA |
| | | TATGCTATCCTAATTTATATCTGGGTAGCATAGGCTATCCTAATCT |
| | | ATATCTGGGTAGCATATGCTATCCTAATCTATATCTGGGTAGTATA |
| | | TGCTATCCTAATCTGTATCCGGGTAGCATATGCTATCCTAATAGAG |
| | | ATTAGGGTAGTATATGCTATCCTAATTTATATCTGGGTAGCATATA |
| | | CTACCCAAATATCTGGATAGCATATGCTATCCTAATCTATATCTGG |
| | | GTAGCATATGCTATCCTAATCTATATCTGGGTAGCATAGGCTATCC |
| | | TAATCTATATCTGGGTAGCATATGCTATCCTAATCTATATCTGGGT |
| | | AGTATATGCTATCCTAATTTATATCTGGGTAGCATAGGCTATCCTA |
| | | ATCTATATCTGGGTAGCATATGCTATCCTAATCTATATCTGGGTAG |
| | | TATATGCTATCCTAATCTGTATCCGGGTAGCATATGCTATCCTCAT |
| | | GATAAGCTGTCAAACATGAGAATTTTCTTGAAGACGAAAGGGCCTC |
| | | GTGATACGCCTATTTTTATAGGTTAATGTCATGATAATAATGGTTT |
| | | CTTAGACGTCAGGTGGCACTTTTCGGGGAAATGTGCGCGGAACCCC |
| | | TATTTGTTTATTTTTCTAAATACATTCAAATATGTATCCGCTCATG |
| | | AGACAATAACCCTGATAAATGCTTCAATAATATTGAAAAGGAAGA |
| | | GTATGAGTATTCAACATTTCCGTGTCGCCCTTATTCCCTTTTTTGC |
| | | GGCATTTTGCCTTCCTGTTTTTGCTCACCCAGAAACGCTGGTGAAA |
| | | GTAAAAGATGCTGAAGATCAGTTGGGTGCACGAGTGGGTTACATCG |
| | | AACTGGATCTCAACAGCGGTAAGATCCTTGAGAGTTTTCGCCCCGA |
| | | AGAACGTTTTCCAATGATGAGCACTTTTAAAGTTCTGCTATGTGGC |
| | | GCGGTATTATCCCGTGTTGACGCCGGGCAAGAGCAACTCGGTCGCC |
| | | GCATACACTATTCTCAGAATGACTTGGTTGAGTACTCACCAGTCAC |
| | | AGAAAAGCATCTTACGGATGGCATGACAGTAAGAGAATTATGCAGT |
| | | GCTGCCATAACCATGAGTGATAACACTGCGGCCAACTTACTTCTGA |
| | | CAACGATCGGAGGACCGAAGGAGCTAACCGCTTTTTTGCACAACAT |
| | | GGGGGATCATGTAACTCGCCTTGATCGTTGGGAACCGGAGCTGAAT |
| | | GAAGCCATACCAAACGACGAGCGTGACACCACGATGCCTGCAGCAA |
| | | TGGCAACAACGTTGCGCAAACTATTAACTGGCGAACTACTTACTCT |
| | | AGCTTCCCGGCAACAATTAATAGACTGGATGGAGGCGGATAAAGTT |
| | | GCAGGACCACTTCTGCGCTCGGCCCTTCCGGCTGGCTGGTTTATTG |
| | | CTGATAAATCTGGAGCCGGTGAGCGTGGGTCTCGCGGTATCATTGC |
| | | AGCACTGGGGCCAGATGGTAAGCCCTCCCGTATCGTAGTTATCTAC |
| | | ACGACGGGAGTCAGGCAACTATGGATGAACGAAATAGACAGATCG |
| | | CTGAGATAGGTGCCTCACTGATTAAGCATTGGTAACTGTCAGACCA |
| | | AGTTTACTCATATATACTTTAGATTGATTTAAAACTTCATTTTTAA |
| | | TTTAAAGGATCTAGGTGAAGATCCTTTTTGATAATCTCATGACCA |
| | | AAATCCCTTAACGTGAGTTTTCGTTCCACTGAGCGTCAGACCCCGT |

TABLE 74-continued

| Vector name | SEQ ID NO | Nucleotide sequences |
|---|---|---|
| | | AGAAAAGATCAAAGGATCTTCTTGAGATCCTTTTTTCTGCGCGTA<br>ATCTGCTGCTTGCAAACAAAAAAACCACCGCTACCAGCGGTGGTTT<br>GTTTGCCGGATCAAGAGCTACCAACTCTTTTTCCGAAGGTAACTGG<br>CTTCAGCAGAGCGCAGATACCAAATACTGTTCTTCTAGTGTAGCCG<br>TAGTTAGGCCACCACTTCAAGAACTCTGTAGCACCGCCTACATACC<br>TCGCTCTGCTAATCCTGTTACCAGTGGCTGCTGCCAGTGGCGATAA<br>GTCGTGTCTTACCGGGTTGGACTCAAGACGATAGTTACCGGATAAG<br>GCGCAGCGGTCGGGCTGAACGGGGGGTTCGTGCACACAGCCCAGCT<br>TGGAGCGAACGACCTACACCGAACTGAGATACCTACAGCGTGAGCT<br>ATGAGAAAGCGCCACGCTTCCCGAAGGGAGAAAGGCGGACAGGTAT<br>CCGGTAAGCGGCAGGGTCGGAACAGGAGAGCGCACGAGGGAGCTTC<br>CAGGGGGAAACGCCTGGTATCTTTATAGTCCTGTCGGGTTTCGCCA<br>CCTCTGACTTGAGCGTCGATTTTTGTGATGCTCGTCAGGGGGCGG<br>AGCCTATGGAAAAACGCCAGCAACGCGGCCTTTTTACGGTTCCTGG<br>CCTTTTGCTGGCCTTTTGCTCACATGTTCTTTCCTGCGTTATCCCC<br>TGATTCTGTGGATAACCGTATTACCGCCTTTGAGTGAGCTGATACC<br>GCTCGCCGCAGCCGAACGACCGAGCGCAGCGAGTCAGTGAGCGAGG<br>AAGCGGAAGAGCGCCCAATACGCAAACCGCCTCTCCCCGCGCGTTG<br>GCCGATTCATTAATGCAGCTGGCACGACAGGTTTCCCGACTGGAAA<br>GCGGGCAGTGAGCGCAACGCAATTAATGTGAGTTAGCTCACTCATT<br>AGGCACCCCAGGCTTTACACTTTATGCTTCCGGCTCGTATGTTGTG<br>TGGAATTGTGAGCGGATAACAATTTCACACAGGAAACAGCTATGAC<br>CATGATTACGCCAAGCTCTAGCTAGAGGTCGAGTCCCTCCCCAGCA<br>GGCAGAAGTATGCAAAGCATGCATCTCAATTAGTCAGCAACCATAG<br>TCCCGCCCCTAACTCCGCCCATCCCGCCCCTAACTCCGCCCAGTTC<br>CGCCCATTCTCCGCCCCATGGCTGACTAATTTTTTTTATTTATGCA<br>GAGGCCGAGGCCGCCTCGGCCTCTGAGCTATTCCAGAAGTAGTGAG<br>GAGGCTTTTTTGGAGGCCTAGGCTTTTGCAAAAAGCTTTGCAAAGA<br>TGGATAAAGTTTTAAACAGAGAGGAATCTTTGCAGCTAATGGACCT<br>TCTAGGTCTTGAAAGGAGTGGGAATTGGCTCCGGTGCCCGTCAGTG<br>GGCAGAGCGCACATCGCCCACAGTCCCCGAGAAGTTGGGGGGAGGG<br>GTCGGCAATTGAACCGGTGCCTAGAGAAGGTGGCGCGGGGTAAACT<br>GGGAAAGTGATGTCGTGTACTGGCTCCGCCTTTTTCCCGAGGGTGG<br>GGGAGAACCGTATATAAGTGCAGTAGTCGCCGTGAACGTTCTTTTT<br>CGCAACGGGTTTGCCGCCAGAACACAGGTAAGTGCCGTGTGTGGTT<br>CCCGCGGGCCTGGCCTCTTTACGGGTTATGGCCCTTGCGTGCCTTG<br>AATTACTTCCACCTGGCTGCAGTACGTGATTCTTGATCCCGAGCTT<br>CGGGTTGGAAGTGGGTGGGAGAGTTCGAGGCCTTGCGCTTAAGGAG<br>CCCCTTCGCCTCGTGCTTGAGTTGAGGCCTGGCCTGGGCGCTGGGG<br>CCGCCGCGTGCGAATCTGGTGGCACCTTCGCGCCTGTCTCGCTGCT<br>TTCGATAAGTCTCTAGCCATTTAAAATTTTTGATGACCTGCTGCGA<br>CGCTTTTTTTCTGGCAAGATAGTCTTGTAAATGCGGGCCAAGATCT<br>GCACACTGGTATTTCGGTTTTTGGGGCCGCGGGCGGCGACGGGGCC<br>CGTGCGTCCCAGCGCACATGTTCGGCGAGGCGGGGCCTGCGAGCGC<br>GGCCACCGAGAATCGGACGGGGGTAGTCTCAAGCTGGCCGGCCTGC<br>TCTGGTGCCTGGCCTCGCGCCGCCGTGTATCGCCCCGCCCTGGGCG<br>GCAAGGCTGGCCCGGTCGGCACCAGTTGCGTGAGCGGAAAGATGGC<br>CGCTTCCCGGCCCTGCTGCAGGGAGCTCAAAATGGAGGACGCGGCG<br>CTCGGGAGAGCGGGCGGGTGAGTCACCCACACAAAGGAAAAGGGCC<br>TTTCCGTCCTCAGCCGTCGCTTCATGTGACTCCACGGAGTACCGGG<br>CGCCGTCCAGGCACCTCGATTAGTTCTCGAGCTTTTGGAGTACGTC<br>GTCTTTAGGTTGGGGGAGGGGTTTTATGCGATGGAGTTTCCCCAC<br>ACTGAGTGGGTGGAGACTGAAGTTAGGCCAGCTTGGCACTTGATGT<br>AATTCTCCTTGGAATTTGCCCTTTTTGAGTTTGGATCTTGGTTCAT<br>TCTCAAGCCTCAGACAGTGGTTCAAAGTTTTTTTCTTCCATTTCAG<br>GTGTCGTGAGGAATTCTCTAGAGATCCCTCGACCTCGAGATCCATT<br>GTGCCCGGCGCACCATGGACATGCGCGTGCCCGCCCAGCTGCTGG<br>GCCTGCTGCTGCTGTGGTTCCCCGGCTCGCGATGC |
| V3 | 292 | CAACCCAAGGCTGCCCCCTCGGTCACTCTGTTCCCGCCCTCCTCTG<br>AGGAGCTTCAAGCCAACAAGGCCACACTGGTGTGTCTCATAAGTGA<br>CTTCTACCCGGGAGCCGTGACAGTGGCCTGGAAGGCAGATAGCAGC<br>CCCGTCAAGGCGGGAGTGGAGACCACCACACCCTCCAAACAAAGCA<br>ACAACAAGTACGCGGCCAGCAGCTACCTGAGCCTGACGCCTGAGCA<br>GTGGAAGTCCCACAGAAGCTACAGCTGCCAGGTCACGCATGAAGGG<br>AGCACCGTGGAGAAGACAGTGGCCCCTACAGAATGTTCATGAGCGG<br>CCGCTCGAGGCCGGCAAGGCCGGATCCCCCGACCTCGACCTCTGGC<br>TAATAAAGGAAATTTATTTTCATTGCAATAGTGTGTTGGAATTTTT<br>TGTGTCTCTCACTCGGAAGGACATATGGGAGGGCAAATCATTTGGT<br>CGAGATCCCTCGGAGATCTCTAGCTAGAGGATCGATCCCCGCCCCG<br>GACGAACTAAACCTGACTACGACATCTCTGCCCCTTCTTCGCGGGG<br>CAGTGCATGTAATCCCTTCAGTTGGTTGGTACAACTTGCCAACTGG<br>GCCCTGTTCCACATGTGACACGGGGGGGACCAAACACAAAGGGGT<br>TCTCTGACTGTAGTTGACATCCTTATAAATGGATGTGCACATTTGC<br>AACACTGAGTGGCTTTCATCCTGGAGCAGACTTTGCAGTCTGTGG<br>ACTGCAACACAACATTGCCTTTATGTGTAACTCTTGGCTGAAGCTC |

TABLE 74-continued

| Vector name | SEQ ID NO | Nucleotide sequences 12345678901234567890123456789012345678901234567890123456 78901 |
|---|---|---|
| | | TTACACCAATGCTGGGGGACATGTACCTCCCAGGGGCCCAGGAAGA |
| | | CTACGGGAGGCTACACCAACGTCAATCAGAGGGGCCTGTGTAGCTA |
| | | CCGATAAGCGGACCCTCAAGAGGGCATTAGCAATAGTGTTTATAAG |
| | | GCCCCCTTGTTAACCCTAAACGGGTAGCATATGCTTCCCGGGTAGT |
| | | AGTATATACTATCCAGACTAACCCTAATTCAATAGCATATGTTACC |
| | | CAACGGGAAGCATATGCTATCGAATTAGGGTTAGTAAAAGGGTCCT |
| | | AAGGAACAGCGATATCTCCCACCCCATGAGCTGTCACGGTTTTATT |
| | | TACATGGGGTCAGGATTCCACGAGGGTAGTGAACCATTTTAGTCAC |
| | | AAGGGCAGTGGCTGAAGATCAAGGAGCGGGCAGTGAACTCTCCTGA |
| | | ATCTTCGCCTGCTTCTTCATTCTCCTTCGTTTAGCTAATAGAATAA |
| | | CTGCTGAGTTGTGAACAGTAAGGTGTATGTGAGGTGCTCGAAAACA |
| | | AGGTTTCAGGTGACGCCCCCAGAATAAAATTTGGACGGGGGGTTCA |
| | | GTGGTGGCATTGTGCTATGACACCAATATAACCCTCACAAACCCCT |
| | | TGGGCAATAAATACTAGTGTAGGAATGAAACATTCTGAATATCTTT |
| | | AACAATAGAAATCCATGGGGTGGGACAAGCCGTAAAGACTGGATG |
| | | TCCATCTCACACGAATTTATGGCTATGGGCAACACATAATCCTAGT |
| | | GCAAATATGATACTGGGGTTATTAAGATGTGTCCCAGGCAGGGACCA |
| | | AGACAGGTGAACCATGTTGTTACACTCTATTTGTAACAAGGGGAAA |
| | | GAGAGTGGACGCCGACAGCAGCGGACTCCACTGGTTGTCTCTAACA |
| | | CCCCCGAAAATTAAACGGGGCTCCACGCCAATGGGGCCCATAAACA |
| | | AAGACAAGTGGCCACTCTTTTTTTTGAAATTGTGGAGTGGGGCAC |
| | | GCGTCAGCCCCCACACGCCGCCCTGCGGTTTTGGACTGTAAAATAA |
| | | GGGTGTAATAACTTGGCTGATTGTAACCCCGCTAACCACTGCGGTC |
| | | AAACCACTTGCCCACAAAACCACTAATGGCACCCCGGGGAATACCT |
| | | GCATAAGTAGGTGGGCGGGCAAGATAGGGGCGCGATTGCTGCGAT |
| | | CTGGAGGACAAATTACACACACTTGCGCCTGAGCGCCAAGCACAGG |
| | | GTTGTTGGTCCTCATATTCACGAGGTCGCTGAGAGCACGGTGGGCT |
| | | AATGTTGCCATGGGTAGCATATACTACCCAAATATCTGGATAGCAT |
| | | ATGCTATCCTAATCTATATCTGGGTAGCATAGGCTATCCTAATCTA |
| | | TATCTGGGTAGCATATGCTATCCTAATCTATATCTGGGTAGTATAT |
| | | GCTATCCTAATTTATATCTGGGTAGCATAGGCTATCCTAATCTATA |
| | | TCTGGGTAGCATATGCTATCCTAATCTATATCTGGGTAGTATATGC |
| | | TATCCTAATCTGTATCCGGGTAGCATATGCTATCCTAATAGAGATT |
| | | AGGGTAGTATATGCTATCCTAATTTATATCTGGGTAGCATATACTA |
| | | CCCAAATATCTGGATAGCATATGCTATCCTAATCTATATCTGGGTA |
| | | GCATATGCTATCCTAATCTATATCTGGGTAGCATAGGCTATCCTAA |
| | | TCTATATCTGGGTAGCATATGCTATCCTAATCTATATCTGGGTAGT |
| | | ATATGCTATCCTAATTTATATCTGGGTAGCATAGGCTATCCTAATC |
| | | TATATCTGGGTAGCATATGCTATCCTAATCTATATCTGGGTAGTAT |
| | | ATGCTATCCTAATCTGTATCCGGGTAGCATATGCTATCCTCATGAT |
| | | AAGCTGTCAAACATGAGAATTTTCTTGAAGACGAAAGGGCCTCGTG |
| | | ATACGCCTATTTTTATAGGTTAATGTCATGATAATAATGTTTCTT |
| | | AGACGTCAGGTGGCACTTTTCGGGGAAATGTGCGCGGAACCCCTAT |
| | | TTGTTTATTTTTCTAAATACATTCAAATATGTATCCGCTCATGAGA |
| | | CAATAACCCTGATAAATGCTTCAATAATATTGAAAAAGGAAGAGTA |
| | | TGAGTATTCAACATTTCCGTGTCGCCCTTATTCCCTTTTTTGCGGC |
| | | ATTTTGCCTTCCTGTTTTTGCTCACCCAGAAACGCTGGTGAAAGTA |
| | | AAAGATGCTGAAGATCAGTTGGGTGCACGAGTGGGTTACATCGAAC |
| | | TGGATCTCAACAGCGGTAAGATCCTTGAGAGTTTTCGCCCCGAAGA |
| | | ACGTTTTCCAATGATGAGCACTTTTAAAGTTCTGCTATGTGGCGCG |
| | | GTATTATCCCGTGTTGACGCCGGGCAAGAGCAACTCGGTCGCCGCA |
| | | TACACTATTCTCAGAATGACTTGGTTGAGTACTCACCAGTCACAGA |
| | | AAAGCATCTTACGGATGGCATGACAGTAAGAGAATTATGCAGTGCT |
| | | GCCATAACCATGAGTGATAACACTGCGGCCAACTTACTTCTGACAA |
| | | CGATCGGAGGACCGAAGGAGCTAACCGCTTTTTTGCACAACATGGG |
| | | GGATCATGTAACTCGCCTTGATCGTTGGGAACCGGAGCTGAATGAA |
| | | GCCATACCAAACGACGAGCGTGACACCACGATGCCTGCAGCAATGG |
| | | CAACAACGTTGCGCAAACTATTAACTGGCGAACTACTTACTCTAGC |
| | | TTCCCGGCAACAATTAATAGACTGGATGGAGGCGGATAAAGTTGCA |
| | | GGACCACTTCTGCGCTCGGCCCTTCCGGCTGGCTGGTTTATTGCTG |
| | | ATAAATCTGGAGCCGGTGAGCGTGGGTCTCGCGGTATCATTGCAGC |
| | | ACTGGGGCCAGATGGTAAGCCCTCCCGTATCGTAGTTATCTACACG |
| | | ACGGGGAGTCAGGCAACTATGGATGAACGAAATAGACAGATCGCTG |
| | | AGATAGGTGCCTCACTGATTAAGCATTGGTAACTGTCAGACCAAGT |
| | | TTACTCATATATACTTTAGATTGATTTAAAACTTCATTTTTAATTT |
| | | AAAAGGATCTAGGTGAAGATCCTTTTTGATAATCTCATGACCAAAA |
| | | TCCCTTAACGTGAGTTTTCGTTCCACTGAGCGTCAGACCCCGTAGA |
| | | AAAGATCAAAGGATCTTCTTGAGATCCTTTTTTTCTGCGCGTAATC |
| | | TGCTGCTTGCAAACAAAAAAACCACCGCTACCAGCGGTGGTTTGTT |
| | | TGCCGGATCAAGAGCTACCAACTCTTTTTCCGAAGGTAACTGGCTT |
| | | CAGCAGAGCGCAGATACCAAATACTGTTCTTCTAGTGTAGCCGTAG |
| | | TTAGGCCACCACTTCAAGAACTCTGTAGCACCGCCTACATACCTCG |
| | | CTCTGCTAATCCTGTTACCAGTGGCTGCTGCCAGTGGCGATAAGTC |
| | | GTGTCTTACCGGGTTGGACTCAAGACGATAGTTACCGGATAAGGCG |
| | | CAGCGGTCGGGCTGAACGGGGGGTTCGTGCACACAGCCCAGCTTGG |
| | | AGCGAACGACCTACACCGAACTGAGATACCTACAGCGTGAGCTATG |

TABLE 74-continued

| Vector name | SEQ ID NO | Nucleotide sequences |
|---|---|---|
| | | AGAAAGCGCCACGCTTCCCGAAGGGAGAAAGGCGGACAGGTATCCG |
| | | GTAAGCGGCAGGGTCGGAACAGGAGAGCGCACGAGGGAGCTTCCAG |
| | | GGGGAAACGCCTGGTATCTTTATAGTCCTGTCGGGTTTCGCCACCT |
| | | CTGACTTGAGCGTCGATTTTTGTGATGCTCGTCAGGGGGGCGGAGC |
| | | CTATGGAAAAACGCCAGCAACGCGGCCTTTTTACGGTTCCTGGCCT |
| | | TTTGCTGGCCTTTTGCTCACATGTTCTTTCCTGCGTTATCCCCTGA |
| | | TTCTGTGGATAACCGTATTACCGCCTTTGAGTGAGCTGATACCGCT |
| | | CGCCGCAGCCGAACGACCGAGCGCAGCGAGTCAGTGAGCGAGGAAG |
| | | CGGAAGAGCGCCCAATACGCAAACCGCCTCTCCCCGCGCGTTGGCC |
| | | GATTCATTAATGCAGCTGGCACGACAGGTTTCCCGACTGGAAAGCG |
| | | GGCAGTGAGCGCAACGCAATTAATGTGAGTTAGCTCACTCATTAGG |
| | | CACCCCAGGCTTTACACTTTATGCTTCCGGCTCGTATGTTGTGTGG |
| | | AATTGTGAGCGGATAACAATTTCACACAGGAAACAGCTATGACCAT |
| | | GATTACGCCAAGCTCTAGCTAGAGGTCGAGTCCCTCCCCAGCAGGC |
| | | AGAAGTATGCAAAGCATGCATCTCAATTAGTCAGCAACCATAGTCC |
| | | CGCCCCTAACTCCGCCCATCCCGCCCCTAACTCCGCCCAGTTCCGC |
| | | CCATTCTCCGCCCCATGGCTGACTAATTTTTTTTATTTATGCAGAG |
| | | GCCGAGGCCGCCTCGGCCTCTGAGCTATTCCAGAAGTAGTGAGGAG |
| | | GCTTTTTTGGAGGCCTAGGCTTTTGCAAAAAGCTTTGCAAAGATGG |
| | | ATAAAGTTTTAAACAGAGAGGAATCTTTGCAGCTAATGGACCTTCT |
| | | AGGTCTTGAAAGGAGTGGGAATTGGCTCCGGTGCCCGTCAGTGGGC |
| | | AGAGCGCACATCGCCCACAGTCCCCGAGAAGTTGGGGGGAGGGGTC |
| | | GGCAATTGAACCGGTGCCTAGAGAAGGTGGCGCGGGGTAAACTGGG |
| | | AAAGTGATGTCGTGTACTGGCTCCGCCTTTTTCCCGAGGGTGGGGG |
| | | AGAACCGTATATAAGTGCAGTAGTCGCCGTGAACGTTCTTTTTCGC |
| | | AACGGGTTTGCCGCCAGAACACAGGTAAGTGCCGTGTGTGGTTCCC |
| | | GCGGGCCTGGCCTCTTTACGGGTTATGGCCCTTGCGTGCCTTGAAT |
| | | TACTTCCACCTGGCTGCAGTACGTGATTCTTGATCCCGAGCTTCGG |
| | | GTTGGAAGTGGGTGGGAGAGTTCGAGGCCTTGCGCTTAAGGAGCCC |
| | | CTTCGCCTCGTGCTTGAGTTGAGGCCTGGCCTGGGCGCTGGGGCCG |
| | | CCGCGTGCGAATCTGGTGGCACCTTCGCGCCTGTCTCGCTGCTTTC |
| | | GATAAGTCTCTAGCCATTTAAAATTTTTGATGACCTGCTGCGACGC |
| | | TTTTTTTCTGGCAAGATAGTCTTGTAAATGCGGGCCAAGATCTGCA |
| | | CACTGGTATTTCGGTTTTTGGGGCCGCGGGCGGCGACGGGGCCCGT |
| | | GCGTCCCAGCGCACATGTTCGGCGAGGCGGGGCCTGCGAGCGCGGC |
| | | CACCGAGAATCGGACGGGGGTAGTCTCAAGCTGGCCGGCCTGCTCT |
| | | GGTGCCTGGCCTCGCGCCGCCGTGTATCGCCCCGCCCTGGGCGGCA |
| | | AGGCTGGCCCGGTCGGCACCAGTTGCGTGAGCGGAAAGATGGCCGC |
| | | TTCCCGGCCCTGCTGCAGGGAGCTCAAAATGGAGGACGCGGCGCTC |
| | | GGGAGAGCGGGCGGGTGAGTCACCCACACAAAGGAAAAGGGCCTTT |
| | | CCGTCCTCAGCCGTCGCTTCATGTGACTCCACGGAGTACCGGGCGC |
| | | CGTCCAGGCACCTCGATTAGTTCTCGAGCTTTTGGAGTACGTCGTC |
| | | TTTAGGTTGGGGGGAGGGGTTTTATGCGATGGAGTTTCCCCACACT |
| | | GAGTGGGTGGAGACTGAAGTTAGGCCAGCTTGGCACTTGATGTAAT |
| | | TCTCCTTGGAATTTGCCCTTTTTGAGTTTGGATCTTGGTTCATTCT |
| | | CAAGCCTCAGACAGTGGTTCAAAGTTTTTTTCTTCCATTTCAGGTG |
| | | TCGTGAGGAATTCTCTAGAGATCCCTCGACCTCGAGATCCATTGTG |
| | | CCCGGGCGCCACCATGACTTGGACCCCACTCCTCTTCCTCACCCTC |
| | | CTCCTCCACTGCACAGGAAGCTTATCG |
| V4 | 293 | ACGGTGGCTGCACCATCTGTCTTCATCTTCCCGCCATCTGATGAGC |
| | | AGTTGAAATCTGGAACTGCCTCTGTTGTGTGCCTGCTGAATAACTT |
| | | CTATCCCAGAGAGGCCAAAGTACAGTGGAAGGTGGATAACGCCCTC |
| | | CAATCGGGTAACTCCCAGGAGAGTGTCACAGAGCAGGACAGCAAGG |
| | | ACAGCACCTACAGCCTCAGCAGCACCCTGACGCTGAGCAAAGCAGA |
| | | CTACGAGAAACACAAAGTCTACGCCTGCGAAGTCACCCATCAGGGC |
| | | CTGAGCTCGCCCGTCACAAAGAGCTTCAACAGGGGAGAGTGTTGAG |
| | | CGGCCGCTCGAGGCCGGCAAGGCCGGATCCCCCGACCTCGACCTCT |
| | | GGCTAATAAAGGAAATTTATTTTCATTGCAATAGTGTGTTGGAATT |
| | | TTTTGTGTCTCTCACTCGGAAGGACATATGGGAGGGCAAATCATTT |
| | | GGTCGAGATCCCTCGGAGATCTCTAGCTAGAGGATCGATCCCCGCC |
| | | CCGGACGAACTAAACCTGACTACGACATCTCTGCCCCTTCTTCGCG |
| | | GGGCAGTGCATGTAATCCCTTCAGTTGGTTGGTACAACTTGCCAAC |
| | | TGGGCCCTGTTCCACATGTGACACGGGGGGGACCAAACACAAAGG |
| | | GGTTCTCTGACTGTAGTTGACATCCTTATAAATGGATGTGCACATT |
| | | TGCCAACACTGAGTGGCTTTCATCCTGGAGCAGACTTTGCAGTCTG |
| | | TGGACTGCAACACAACATTGCCTTTATGTGTAACTCTTGGCTGAAG |
| | | CTCTTACACCAATGCTGGGGACATGTACCTCCCAGGGGCCCAGGA |
| | | AGACTACGGGAGGCTACACCAACGTCAATCAGAGGGGCCTGTGTAG |
| | | CTACCGATAAGCGGACCCTCAAGAGGGCATTAGCAATAGTGTTTAT |
| | | AAGGCCCCCTTGTTAACCCTAAACGGGTAGCATATGCTTCCCGGGT |
| | | AGTAGTATATACTATCCAGACTAACCCTAATTCAATAGCATATGTT |
| | | ACCCAACGGGAAGCATATGCTATCGAATTAGGGTTAGTAAAAGGGT |
| | | CCTAAGGAACAGCGATATCTCCCACCCCATGAGCTGTCACGGTTTT |
| | | ATTTACATGGGGTCAGGATTCCACGAGGGTAGTGAACCATTTTAGT |
| | | CACAAGGGCAGTGGCTGAAGATCAAGGAGCGGGCAGTGAACTCTCC |

TABLE 74-continued

| Vector name | SEQ ID NO | Nucleotide sequences |
|---|---|---|
| | | TGAATCTTCGCCTGCTTCTTCATTCTCCTTCGTTTAGCTAATAGAA |
| | | TAACTGCTGAGTTGTGAACAGTAAGGTGTATGTGAGGTGCTCGAAA |
| | | ACAAGGTTTCAGGTGACGCCCCCAGAATAAAATTTGGACGGGGGGT |
| | | TCAGTGGTGGCATTGTGCTATGACACCAATATAACCCTCACAAACC |
| | | CCTTGGGCAATAAATACTAGTGTAGGAATGAAACATTCTGAATATC |
| | | TTTAACAATAGAAATCCATGGGGTGGGGACAAGCCGTAAAGACTGG |
| | | ATGTCCATCTCACACGAATTTATGGCTATGGGCAACACATAATCCT |
| | | AGTGCAATATGATACTGGGGTTATTAAGATGTGTCCCAGGCAGGGA |
| | | CCAAGACAGGTGAACCATGTTGTTACACTCTATTTGTAACAAGGGG |
| | | AAAGAGAGTGGACGCCGACAGCAGCGGACTCCACTGGTTGTCTCTA |
| | | ACACCCCCGAAAATTAAACGGGGCTCCACGCCAATGGGGCCCATAA |
| | | ACAAAGACAAGTGGCCACTCTTTTTTTTGAAATTGTGGAGTGGGGG |
| | | CACGCGTCAGCCCCCACACGCCGCCCTGCGGTTTTGGACTGTAAAA |
| | | TAAGGGTGTAATAACTTGGCTGATTGTAACCCCGCTAACCACTGCG |
| | | GTCAAACCACTTGCCCACAAAACCACTAATGGCACCCCGGGGAATA |
| | | CCTGCATAAGTAGGTGGGCGGGCCAAGATAGGGGCGCGATTGCTGC |
| | | GATCTGGAGGACAAATTACACACACTTGCGCCTGAGCGCCAAGCAC |
| | | AGGGTTGTTGGTCCTCATATTCACGAGGTCGCTGAGAGCACGGTGG |
| | | GCTAATGTTGCCATGGGTAGCATATACTACCCAAATATCTGGATAG |
| | | CATATGCTATCCTAATCTATATCTGGGTAGCATAGGCTATCCTAAT |
| | | CTATATCTGGGTAGCATATGCTATCCTAATCTATATCTGGGTAGTA |
| | | TATGCTATCCTAATTTATATCTGGGTAGCATAGGCTATCCTAATCT |
| | | ATATCTGGGTAGCATATGCTATCCTAATCTATATCTGGGTAGTATA |
| | | TGCTATCCTAATCTGTATCCGGGTAGCATATGCTATCCTAATAGAG |
| | | ATTAGGGTAGTATATGCTATCCTAATTTATATCTGGGTAGCATATA |
| | | CTACCCAAATATCTGGATAGCATATGCTATCCTAATCTATATCTGG |
| | | GTAGCATATGCTATCCTAATCTATATCTGGGTAGCATAGGCTATCC |
| | | TAATCTATATCTGGGTAGCATATGCTATCCTAATCTATATCTGGGT |
| | | AGTATATGCTATCCTAATTTATATCTGGGTAGCATAGGCTATCCTA |
| | | ATCTATATCTGGGTAGCATATGCTATCCTAATCTATATCTGGGTAG |
| | | TATATGCTATCCTAATCTGTATCCGGGTAGCATATGCTATCCTCAT |
| | | GATAAGCTGTCAAACATGAGAATTTTCTTGAAGACGAAAGGGCCTC |
| | | GTGATACGCCTATTTTTATAGGTTAATGTCATGATAATAATGGTTT |
| | | CTTAGACGTCAGGTGGCACTTTTCGGGGAAATGTGCGCGGAACCCC |
| | | TATTTGTTTATTTTTCTAAATACATTCAAATATGTATCCGCTCATG |
| | | AGACAATAACCCTGATAAATGCTTCAATAATATTGAAAAAGGAAGA |
| | | GTATGAGTATTCAACATTTCCGTGTCGCCCTTATTCCCTTTTTTGC |
| | | GGCATTTTGCCTTCCTGTTTTTGCTCACCCAGAAACGCTGGTGAAA |
| | | GTAAAAGATGCTGAAGATCAGTTGGGTGCACGAGTGGGTTACATCG |
| | | AACTGGATCTCAACAGCGGTAAGATCCTTGAGAGTTTTCGCCCCGA |
| | | AGAACGTTTTCCAATGATGAGCACTTTTAAAGTTCTGCTATGTGGC |
| | | GCGGTATTATCCCGTGTTGACGCCGGGCAAGAGCAACTCGGTCGCC |
| | | GCATACACTATTCTCAGAATGACTTGGTTGAGTACTCACCAGTCAC |
| | | AGAAAAGCATCTTACGGATGGCATGACAGTAAGAGAATTATGCAGT |
| | | GCTGCCATAACCATGAGTGATAACACTGCGGCCAACTTACTTCTGA |
| | | CAACGATCGGAGGACCGAAGGAGCTAACCGCTTTTTTGCACAACAT |
| | | GGGGGATCATGTAACTCGCCTTGATCGTTGGGAACCGGAGCTGAAT |
| | | GAAGCCATACCAAACGACGAGCGTGACACCACGATGCCTGCAGCAA |
| | | TGGCAACAACGTTGCGCAAACTATTAACTGGCGAACTACTTACTCT |
| | | AGCTTCCCGGCAACAATTAATAGACTGGATGGAGGCGGATAAAGTT |
| | | GCAGGACCACTTCTGCGCTCGGCCCTTCCGGCTGGCTGGTTTATTG |
| | | CTGATAAATCTGGAGCCGGTGAGCGTGGGTCTCGCGGTATCATTGC |
| | | AGCACTGGGGCCAGATGGTAAGCCCTCCCGTATCGTAGTTATCTAC |
| | | ACGACGGGGAGTCAGGCAACTATGGATGAACGAAATAGACAGATCG |
| | | CTGAGATAGGTGCCTCACTGATTAAGCATTGGTAACTGTCAGACCA |
| | | AGTTTACTCATATATACTTTAGATTGATTTAAAACTTCATTTTTAA |
| | | TTTAAAAGGATCTAGGTGAAGATCCTTTTTGATAATCTCATGACCA |
| | | AAATCCCTTAACGTGAGTTTTCGTTCCACTGAGCGTCAGACCCCGT |
| | | AGAAAAGATCAAAGGATCTTCTTGAGATCCTTTTTTTCTGCGCGTA |
| | | ATCTGCTGCTTGCAAACAAAAAAACCACCGCTACCAGCGGTGGTTT |
| | | GTTTGCCGGATCAAGAGCTACCAACTCTTTTTCCGAAGGTAACTGG |
| | | CTTCAGCAGAGCGCAGATACCAAATACTGTTCTTCTAGTGTAGCCG |
| | | TAGTTAGGCCACCACTTCAAGAACTCTGTAGCACCGCCTACATACC |
| | | TCGCTCTGCTAATCCTGTTACCAGTGGCTGCTGCCAGTGGCGATAA |
| | | GTCGTGTCTTACCGGGTTGGACTCAAGACGATAGTTACCGGATAAG |
| | | GCGCAGCGGTCGGGCTGAACGGGGGGTTCGTGCACACAGCCCAGCT |
| | | TGGAGCGAACGACCTACACCGAACTGAGATACCTACAGCGTGAGCT |
| | | ATGAGAAAGCGCCACGCTTCCCGAAGGGAGAAAGGCGGACAGGTAT |
| | | CCGGTAAGCGGCAGGGTCGGAACAGGAGAGCGCACGAGGGAGCTTC |
| | | CAGGGGGAAACGCCTGGTATCTTTATAGTCCTGTCGGGTTTCGCCA |
| | | CCTCTGACTTGAGCGTCGATTTTTGTGATGCTCGTCAGGGGGGCGG |
| | | AGCCTATGGAAAAACGCCAGCAACGCGGCCTTTTTACGGTTCCTGG |
| | | CCTTTTGCTGGCCTTTTGCTCACATGTTCTTTCCTGCGTTATCCCC |
| | | TGATTCTGTGGATAACCGTATTACCGCCTTTGAGTGAGCTGATACC |
| | | GCTCGCCGCAGCCGAACGACCGAGCGCAGCGAGTCAGTGAGCGAGG |
| | | AAGCGGAAGAGCGCCCAATACGCAAACCGCCTCTCCCCGCGCGTTG |

TABLE 74-continued

| Vector name | SEQ ID NO | Nucleotide sequences |
|---|---|---|
| | | GCCGATTCATTAATGCAGCTGGCACGACAGGTTTCCCGACTGGAAA |
| | | GCGGGCAGTGAGCGCAACGCAATTAATGTGAGTTAGCTCACTCATT |
| | | AGGCACCCCAGGCTTTACACTTTATGCTTCCGGCTCGTATGTTGTG |
| | | TGGAATTGTGAGCGGATAACAATTTCACACAGGAAACAGCTATGAC |
| | | CATGATTACGCCAAGCTCTAGCTAGAGGTCGAGTCCCTCCCCAGCA |
| | | GGCAGAAGTATGCAAAGCATGCATCTCAATTAGTCAGCAACCATAG |
| | | TCCCGCCCCTAACTCCGCCCATCCCGCCCCTAACTCCGCCCAGTTC |
| | | CGCCCATTCTCCGCCCCATGGCTGACTAATTTTTTTTATTTATGCA |
| | | GAGGCCGAGGCCGCCTCGGCCTCTGAGCTATTCCAGAAGTAGTGAG |
| | | GAGGCTTTTTTGGAGGCCTAGGCTTTTGCAAAAAGCTTTGCAAAGA |
| | | TGGATAAAGTTTTAAACAGAGAGGAATCTTTGCAGCTAATGGACCT |
| | | TCTAGGTCTTGAAAGGAGTGGGAATTGGCTCCGGTGCCCGTCAGTG |
| | | GGCAGAGCGCACATCGCCCACAGTCCCCGAGAAGTTGGGGGGAGGG |
| | | GTCGGCAATTGAACCGGTGCCTAGAGAAGGTGGCGCGGGGTAAACT |
| | | GGGAAAGTGATGTCGTGTACTGGCTCCGCCTTTTTCCCGAGGGTGG |
| | | GGGAGAACCGTATATAAGTGCAGTAGTCGCCGTGAACGTTCTTTTT |
| | | CGCAACGGGTTTGCCGCCAGAACACAGGTAAGTGCCGTGTGTGGTT |
| | | CCCGCGGGCCTGGCCTCTTTACGGGTTATGGCCCTTGCGTGCCTTG |
| | | AATTACTTCCACCTGGCTGCAGTACGTGATTCTTGATCCCGAGCTT |
| | | CGGGTTGGAAGTGGGTGGGAGAGTTCGAGGCCTTGCGCTTAAGGAG |
| | | CCCCTTCGCCTCGTGCTTGAGTTGAGGCCTGGCCTGGGCGCTGGGG |
| | | CCGCCGCGTGCGAATCTGGTGGCACCTTCGCGCCTGTCTCGCTGCT |
| | | TTCGATAAGTCTCTAGCCATTTAAAATTTTTGATGACCTGCTGCGA |
| | | CGCTTTTTTTCTGGCAAGATAGTCTTGTAAATGCGGGCCAAGATCT |
| | | GCACACTGGTATTTCGGTTTTTGGGGCCGCGGGCGGCGACGGGGCC |
| | | CGTGCGTCCCAGCGCACATGTTCGGCGAGGCGGGGCCTGCGAGCGC |
| | | GGCCACCGAGAATCGGACGGGGGTAGTCTCAAGCTGGCCGGCCTGC |
| | | TCTGGTGCCTGGCCTCGCGCCGCCGTGTATCGCCCCGCCCTGGGCG |
| | | GCAAGGCTGGCCCGGTCGGCACCAGTTGCGTGAGCGGAAAGATGGC |
| | | CGCTTCCCGGCCCTGCTGCAGGGAGCTCAAAATGGAGGACGCGGCG |
| | | CTCGGGAGAGCGGGCGGGTGAGTCACCCACACAAAGGAAAAGGGCC |
| | | TTTCCGTCCTCAGCCGTCGCTTCATGTGACTCCACGGAGTACCGGG |
| | | CGCCGTCCAGGCACCTCGATTAGTTCTCGAGCTTTTGGAGTACGTC |
| | | GTCTTTAGGTTGGGGGGAGGGGTTTTATGCGATGGAGTTTCCCCAC |
| | | ACTGAGTGGGTGGAGACTGAAGTTAGGCCAGCTTGGCACTTGATGT |
| | | AATTCTCCTTGGAATTTGCCCTTTTTGAGTTTGGATCTTGGTTCAT |
| | | TCTCAAGCCTCAGACAGTGGTTCAAAGTTTTTTTCTTCCATTTCAG |
| | | GTGTCGTGAGGAATTCTCTAGAGATCCCTCGACCTCGAGATCCATT |
| | | GTGCCCGGCGCACCATGACTTGGACCCCACTCCTCTTCCTCACCC |
| | | TCCTCCTCCACTGCACAGGAAGCTTATCG |
| V5 | 294 | CAACCCAAGGCTGCCCCCTCGGTCACTCTGTTCCCGCCCTCCTCTG |
| | | AGGAGCTTCAAGCCAACAAGGCCACACTGGTGTGTCTCATAAGTGA |
| | | CTTCTACCCGGGAGCCGTGACAGTGGCCTGGAAGGCAGATAGCAGC |
| | | CCCGTCAAGGCGGGAGTGGAGACCACCACACCCTCCAAACAAAGCA |
| | | ACAACAAGTACGCGGCCAGCAGCTACCTGAGCCTGACGCCTGAGCA |
| | | GTGGAAGTCCCACAGAAGCTACAGCTGCCAGGTCACGCATGAAGGG |
| | | AGCACCGTGGAGAAGACAGTGGCCCCTACAGAATGTTCATGAGCGG |
| | | CCGCTCGAGGCCGGCAAGGCCGGATCCCCCGACCTCGACCTCTGGC |
| | | TAATAAAGGAAATTTATTTTCATTGCAATAGTGTGTTGGAATTTTT |
| | | TGTGTCTCTCACTCGGAAGGACATATGGGAGGGCAAATCATTTGGT |
| | | CGAGATCCCTCGGAGATCTCTAGCTAGAGGATCGATCCCCGCCCCG |
| | | GACGAACTAAACCTGACTACGACATCTCTGCCCCTTCTTCGCGGGG |
| | | CAGTGCATGTAATCCCTTCAGTTGGTTGGTACAACTTGCCAACTGG |
| | | GCCCTGTTCCACATGTGACACGGGGGGGACCAAACACAAAGGGGT |
| | | TCTCTGACTGTAGTTGACATCCTTATAAATGGATGTGCACATTTGC |
| | | CAACACTGAGTGGCTTTCATCCTGGAGCAGACTTTGCAGTCTGTGG |
| | | ACTGCAACACAACATTGCCTTTATGTGTAACTCTTGGCTGAAGCTC |
| | | TTACACCAATGCTGGGGGACATGTACCTCCCAGGGGCCCAGGAAGA |
| | | CTACGGGAGGCTACACCAACGTCAATCAGAGGGGCCTGTGTAGCTA |
| | | CCGATAAGCGGACCCTCAAGAGGGCATTAGCAATAGTGTTTATAAG |
| | | GCCCCCTTGTTAACCCTAAACGGGTAGCATATGCTTCCCGGGTAGT |
| | | AGTATATACTATCCAGACTAACCCTAATTCAATAGCATATGTTACC |
| | | CAACGGGAAGCATATGCTATCGAATTAGGGTTAGTAAAAGGGTCCT |
| | | AAGGAACAGCGATATCTCCCACCCCATGAGCTGTCACGGTTTTATT |
| | | TACATGGGGTCAGGATTCCACGAGGGTAGTGAACCATTTTAGTCAC |
| | | AAGGGCAGTGGCTGAAGATCAAGGAGCGGGCAGTGAACTCCTGA |
| | | ATCTTCGCCTGCTTCTTCATTCTCCTTCGTTTAGCTAATAGAATAA |
| | | CTGCTGAGTTGTGAACAGTAAGGTGTATGTGAGGTGCTCGAAAACA |
| | | AGGTTTCAGGTGACGCCCCAGAATAAAATTTGGACGGGGGGTTCA |
| | | GTGGTGGCATTGTGCTATGACACCAATATAACCCTCACAAACCCCT |
| | | TGGGCAATAAATACTAGTGTAGGAATGAAACATTCTGAATATCTTT |
| | | AACAATAGAAATCCATGGGGTGGGACAAGCCGTAAAGACTGGATG |
| | | TCCATCTCACACGAATTTATGGCTATGGGCAACACATAATCCTAGT |
| | | GCAAATATGACTACTGGGGTTATTAAGATGTGTCCCAGGCAGGGACCA |
| | | AGACAGGTGAACCATGTTGTTACACTCTATTTGTAACAAGGGGAAA |

TABLE 74-continued

Nucleotide sequences

| Vector name | SEQ ID NO | 12345678901234567890123456789012345678901234567890 |
|---|---|---|
| | | GAGAGTGGACGCCGACAGCAGCGGACTCCACTGGTTGTCTCTAACA |
| | | CCCCCGAAAATTAAACGGGGCTCCACGCCAATGGGGCCCATAAACA |
| | | AAGACAAGTGGCCACTCTTTTTTTTGAAATTGTGGAGTGGGGGCAC |
| | | GCGTCAGCCCCCACACGCCGCCCTGCGGTTTTGGACTGTAAAATAA |
| | | GGGTGTAATAACTTGGCTGATTGTAACCCCGCTAACCACTGCGGTC |
| | | AAACCACTTGCCCACAAAACCACTAATGGCACCCCGGGGAATACCT |
| | | GCATAAGTAGGTGGGCGGGCCAAGATAGGGGCGCGATTGCTGCGAT |
| | | CTGGAGGACAAATTACACACACTTGCGCCTGAGCGCCAAGCACAGG |
| | | GTTGTTGGTCCTCATATTCACGAGGTCGCTGAGAGCACGGTGGGCT |
| | | AATGTTGCCATGGGTAGCATATACTACCCAAATATCTGGATAGCAT |
| | | ATGCTATCCTAATCTATATCTGGGTAGCATAGGCTATCCTAATCTA |
| | | TATCTGGGTAGCATATGCTATCCTAATCTATATCTGGGTAGTATAT |
| | | GCTATCCTAATTTATATCTGGGTAGCATAGGCTATCCTAATCTATA |
| | | TCTGGGTAGCATATGCTATCCTAATCTATATCTGGGTAGTATATGC |
| | | TATCCTAATCTGTATCCGGGTAGCATATGCTATCCTAATAGAGATT |
| | | AGGGTAGTATATGCTATCCTAATTTATATCTGGGTAGCATATACTA |
| | | CCCAAATATCTGGATAGCATATGCTATCCTAATCTATATCTGGGTA |
| | | GCATATGCTATCCTAATCTATATCTGGGTAGCATAGGCTATCCTAA |
| | | TCTATATCTGGGTAGCATATGCTATCCTAATCTATATCTGGGTAGT |
| | | ATATGCTATCCTAATTTATATCTGGGTAGCATAGGCTATCCTAATC |
| | | TATATCTGGGTAGCATATGCTATCCTAATCTATATCTGGGTAGTAT |
| | | ATGCTATCCTAATCTGTATCCGGGTAGCATATGCTATCCTCATGAT |
| | | AAGCTGTCAAACATGAGAATTTTCTTGAAGACGAAAGGGCCTCGTG |
| | | ATACGCCTATTTTTATAGGTTAATGTCATGATAATAATGGTTTCTT |
| | | AGACGTCAGGTGGCACTTTTCGGGGAAATGTGCGCGGAACCCCTAT |
| | | TTGTTTATTTTTCTAAATACATTCAAATATGTATCCGCTCATGAGA |
| | | CAATAACCCTGATAAATGCTTCAATAATATTGAAAAAGGAAGAGTA |
| | | TGAGTATTCAACATTTCCGTGTCGCCCTTATTCCCTTTTTTGCGGC |
| | | ATTTTGCCTTCCTGTTTTTGCTCACCCAGAAACGCTGGTGAAAGTA |
| | | AAAGATGCTGAAGATCAGTTGGGTGCACGAGTGGGTTACATCGAAC |
| | | TGGATCTCAACAGCGGTAAGATCCTTGAGAGTTTTCGCCCCGAAGA |
| | | ACGTTTTCCAATGATGAGCACTTTTAAAGTTCTGCTATGTGGCGCG |
| | | GTATTATCCCGTGTTGACGCCGGGCAAGAGCAACTCGGTCGCCGCA |
| | | TACACTATTCTCAGAATGACTTGGTTGAGTACTCACCAGTCACAGA |
| | | AAAGCATCTTACGGATGGCATGACAGTAAGAGAATTATGCAGTGCT |
| | | GCCATAACCATGAGTGATAACACTGCGGCCAACTTACTTCTGACAA |
| | | CGATCGGAGGACCGAAGGAGCTAACCGCTTTTTTGCACAACATGGG |
| | | GGATCATGTAACTCGCCTTGATCGTTGGGAACCGGAGCTGAATGAA |
| | | GCCATACCAAACGACGAGCGTGACACCACGATGCCTGCAGCAATGG |
| | | CAACAACGTTGCGCAAACTATTAACTGGCGAACTACTTACTCTAGC |
| | | TTCCCGGCAACAATTAATAGACTGGATGGAGGCGGATAAAGTTGCA |
| | | GGACCACTTCTGCGCTCGGCCCTTCCGGCTGGCTGGTTTATTGCTG |
| | | ATAAATCTGGAGCCGGTGAGCGTGGGTCTCGCGGTATCATTGCAGC |
| | | ACTGGGGCCAGATGGTAAGCCCTCCCGTATCGTAGTTATCTACACG |
| | | ACGGGGAGTCAGGCAACTATGGATGAACGAAATAGACAGATCGCTG |
| | | AGATAGGTGCCTCACTGATTAAGCATTGGTAACTGTCAGACCAAGT |
| | | TTACTCATATATACTTTAGATTGATTTAAAACTTCATTTTTAATTT |
| | | AAAAGGATCTAGGTGAAGATCCTTTTTGATAATCTCATGACCAAAA |
| | | TCCCTTAACGTGAGTTTTCGTTCCACTGAGCGTCAGACCCCGTAGA |
| | | AAAGATCAAAGGATCTTCTTGAGATCCTTTTTTTCTGCGCGTAATC |
| | | TGCTGCTTGCAAACAAAAAAACCACCGCTACCAGCGGTGGTTTGTT |
| | | TGCCGGATCAAGAGCTACCAACTCTTTTTCCGAAGGTAACTGGCTT |
| | | CAGCAGAGCGCAGATACCAAATACTGTTCTTCTAGTGTAGCCGTAG |
| | | TTAGGCCACCACTTCAAGAACTCTGTAGCACCGCCTACATACCTCG |
| | | CTCTGCTAATCCTGTTACCAGTGGCTGCTGCCAGTGGCGATAAGTC |
| | | GTGTCTTACCGGGTTGGACTCAAGACGATAGTTACCGGATAAGGCG |
| | | CAGCGGTCGGGCTGAACGGGGGGTTCGTGCACACAGCCCAGCTTGG |
| | | AGCGAACGACCTACACCGAACTGAGATACCTACAGCGTGAGCTATG |
| | | AGAAAGCGCCACGCTTCCCGAAGGGAGAAAGGCGGACAGGTATCCG |
| | | GTAAGCGGCAGGGTCGGAACAGGAGAGCGCACGAGGGAGCTTCCAG |
| | | GGGGAAACGCCTGGTATCTTTATAGTCCTGTCGGGTTTCGCCACCT |
| | | CTGACTTGAGCGTCGATTTTTGTGATGCTCGTCAGGGGGCGGAGC |
| | | CTATGGAAAAACGCCAGCAACGCGGCCTTTTTACGGTTCCTGGCCT |
| | | TTTGCTGGCCTTTTGCTCACATGTTCTTTCCTGCGTTATCCCCTGA |
| | | TTCTGTGGATAACCGTATTACCGCCTTTGAGTGAGCTGATACCGCT |
| | | CGCCGCAGCCGAACGACCGAGCGCAGCGAGTCAGTGAGCGAGGAAG |
| | | CGGAAGAGCGCCCAATACGCAAACCGCCTCTCCCCGCGCGTTGGCC |
| | | GATTCATTAATGCAGCTGGCACGACAGGTTTCCCGACTGGAAAGCG |
| | | GGCAGTGAGCGCAACGCAATTAATGTGAGTTAGCTCACTCATTAGG |
| | | CACCCCAGGCTTTACACTTTATGCTTCCGGCTCGTATGTTGTGTGG |
| | | AATTGTGAGCGGATAACAATTTCACACAGGAAACAGCTATGACCAT |
| | | GATTACGCCAAGCTCTAGCTAGAGGTCGAGTCCCTCCCCAGCAGGC |
| | | AGAAGTATGCAAAGCATGCATCTCAATTAGTCAGCAACCATAGTCC |
| | | CGCCCCTAACTCCGCCCATCCCGCCCCTAACTCCGCCCAGTTCCGC |
| | | CCATTCTCCGCCCCATGGCTGACTAATTTTTTTTATTTATGCAGAG |
| | | GCCGAGGCCGCCTCGGCCTCTGAGCTATTCCAGAAGTAGTGAGGAG |

TABLE 74-continued

| Vector name | SEQ ID NO | Nucleotide sequences |
|---|---|---|
| | | GCTTTTTTGGAGGCCTAGGCTTTTGCAAAAAGCTTTGCAAAGATGG<br>ATAAAGTTTTAAACAGAGAGGAATCTTTGCAGCTAATGGACCTTCT<br>AGGTCTTGAAAGGAGTGGGAATTGGCTCCGGTGCCCGTCAGTGGGC<br>AGAGCGCACATCGCCCACAGTCCCCGAGAAGTTGGGGGGAGGGGTC<br>GGCAATTGAACCGGTGCCTAGAGAAGGTGGCGCGGGGTAAACTGGG<br>AAAGTGATGTCGTGTACTGGCTCCGCCTTTTTCCCGAGGGTGGGGG<br>AGAACCGTATATAAGTGCAGTAGTCGCCGTGAACGTTCTTTTTCGC<br>AACGGGTTTGCCGCCAGAACACAGGTAAGTGCCGTGTGTGGTTCCC<br>GCGGGCCTGGCCTCTTTACGGGTTATGGCCCTTGCGTGCCTTGAAT<br>TACTTCCACCTGGCTGCAGTACGTGATTCTTGATCCCGAGCTTCGG<br>GTTGGAAGTGGGTGGGAGAGTTCGAGGCCTTGCGCTTAAGGAGCCC<br>CTTCGCCTCGTGCTTGAGTTGAGGCCTGGCCTGGGCGCTGGGGCCG<br>CCGCGTGCGAATCTGGTGGCACCTTCGCGCCTGTCTCGCTGCTTTC<br>GATAAGTCTCTAGCCATTTAAAATTTTTGATGACCTGCTGCGACGC<br>TTTTTTTCTGGCAAGATAGTCTTGTAAATGCGGGCCAAGATCTGCA<br>CACTGGTATTTCGGTTTTTGGGGCCGCGGGCGGCGACGGGGCCCGT<br>GCGTCCCAGCGCACATGTTCGGCGAGGCGGGGCCTGCGAGCGCGGC<br>CACCGAGAATCGGACGGGGGTAGTCTCAAGCTGGCCGGCCTGCTCT<br>GGTGCCTGGCCTCGCGCCGCCGTGTATCGCCCCGCCCTGGGCGGCA<br>AGGCTGGCCCGGTCGGCACCAGTTGCGTGAGCGGAAAGATGGCCGC<br>TTCCCGGCCCTGCTGCAGGGAGCTCAAAATGGAGGACGCGGCGCTC<br>GGGAGAGCGGGCGGGTGAGTCACCCACACAAAGGAAAAGGGCCTTT<br>CCGTCCTCAGCCGTCGCTTCATGTGACTCCACGGAGTACCGGGCGC<br>CGTCCAGGCACCTCGATTAGTTCTCGAGCTTTTGGAGTACGTCGTC<br>TTTAGGTTGGGGGGAGGGGTTTTATGCGATGGAGTTTCCCCACACT<br>GAGTGGGTGGAGACTGAAGTTAGGCCAGCTTGGCACTTGATGTAAT<br>TCTCCTTGGAATTTGCCCTTTTTGAGTTTGGATCTTGGTTCATTCT<br>CAAGCCTCAGACAGTGGTTCAAAGTTTTTTTCTTCCATTTCAGGTG<br>TCGTGAGGAATTCTCTAGAGATCCCTCGACCTCGAGATCCATTGTG<br>CCCGGGCGCCACCATGGACATGCGCGTGCCCGCCCAGCTGCTGGGC<br>CTGCTGCTGCTGTGGTTCCCCGGCTCGCGATGC |
| V7 | 295 | GCGTCGACCAAGGGCCCATCGGTCTTCCCCCTGGCACCCTCCTCCA<br>AGAGCACCTCTGGGGGCACAGCGGCCCTGGGCTGCCTGGTCAAGGA<br>CTACTTCCCCGAACCGGTGACGGTGTCGTGGAACTCAGGCGCCCTG<br>ACCAGCGGCGTGCACACCTTCCCGGCTGTCCTACAGTCCTCAGGAC<br>TCTACTCCCTCAGCAGCGTGGTGACCGTGCCCTCCAGCAGCTTGGG<br>CACCCAGACCTACATCTGCAACGTGAATCACAAGCCCAGCAACACC<br>AAGGTGGACAAGAAAGTTGAGCCCAAATCTTGTGACAAAACTCACA<br>CATGCCCACCGTGCCCAGCACCTGAAGCGCGGGGGGACCGTCAGT<br>CTTCCTCTTCCCCCCAAAACCCAAGGACACCCTCATGATCTCCCGG<br>ACCCCTGAGGTCACATGCGTGGTGGTGGACGTGAGCCACGAAGACC<br>CTGAGGTCAAGTTCAACTGGTACGTGGACGGCGTGGAGGTGCATAA<br>TGCCAAGACAAAGCCGCGGGAGGAGCAGTACAACAGCACGTACCGT<br>GTGGTCAGCGTCCTCACCGTCCTGCACCAGGACTGGCTGAATGGCA<br>AGGAGTACAAGTGCAAGGTCTCCAACAAAGCCCTCCCAGCCCCCAT<br>CGAGAAAACCATCTCCAAAGCCAAAGGGCAGCCCCGAGAACCACAG<br>GTGTACACCCTGCCCCCATCCCGCGAGGAGATGACCAAGAACCAGG<br>TCAGCCTGACCTGCCTGGTCAAAGGCTTCTATCCCAGCGACATCGC<br>CGTGGAGTGGGAGAGCAATGGGCAGCCGGAGAACAACTACAAGACC<br>ACGCCTCCCGTGCTGGACTCCGACGGCTCCTTCTTCCTCTACAGCA<br>AGCTCACCGTGGACAAGAGCAGGTGGCAGCAGGGGAACGTCTTCTC<br>ATGCTCCGTGATGCATGAGGCTCTGCACAACCACTACACGCAGAAG<br>AGCCTCTCCCTGTCTCCGGGTAAATGAGCGGCCGCTCGAGGCCGGC<br>AAGGCCGGATCCCCCGACCTCGACCTCTGGCTAATAAAGGAAATTT<br>ATTTTCATTGCAATAGTGTGTTGGAATTTTTTGTGTCTCTCACTCG<br>GAAGGACATATGGGAGGGCAAATCATTTGGTCGAGATCCCTCGGAG<br>ATCTCTAGCTAGAGGATCGATCCCCGCCCCGGACGAACTAAACCTG<br>ACTACGACATCTCTGCCCCTTCTTCGCGGGGCAGTGCATGTAATCC<br>CTTCAGTTGGTTGGTACAACTTGCCAACTGGGCCCTGTTCCACATG<br>TGACACGGGGGGGACCAAACACAAAGGGGTTCTCTGACTGTAGTT<br>GACATCCTTATAAATGGATGTGCACATTTGCCAACACTGAGTGGCT<br>TTCATCCTGGAGCAGACTTTGCAGTCTGTGGACTGCAACACAACAT<br>TGCCTTTATGTGTAACTCTTGGCTGAAGCTCTTACACCAATGCTGG<br>GGGACATGTACCTCCCAGGGGCCCAGGAAGACTACGGGAGGCTACA<br>CCAACGTCAATCAGAGGGGCCTGTGTAGCTACCGATAAGCGGACCC<br>TCAAGAGGGCATTAGCAATAGTGTTTATAAGGCCCCCTTGTTAACC<br>CTAAACGGGTAGCATATGCTTCCCGGGTAGTAGTATATACTATCCA<br>GACTAACCCTAATTCAATAGCATATGTTACCCAACGGGAAGCATAT<br>GCTATCGAATTAGGGTTAGTAAAAGGGTCCTAAGGAACAGCGATAT<br>CTCCCACCCCATGAGCTGTCACGGTTTTATTTACATGGGGTCAGGA<br>TTCCACGAGGGTAGTGAACCATTTTAGTCACAAGGGCAGTGGCTGA<br>AGATCAAGGAGCGGGCAGTGAACTCTCCTGAATCTTCGCCTGCTTC<br>TTCATTCTCCTTCGTTTAGCTAATAGAATAACTGCTGAGTTGTGAA<br>CAGTAAGGTGTATGTGAGGTGCTCGAAAACAAGGTTTCAGGTGACG<br>CCCCCAGAATAAAATTTGGACGGGGGGTTCAGTGGTGGCATTGTGC |

TABLE 74-continued

| Vector name | SEQ ID NO | Nucleotide sequences |
|---|---|---|
| | | TATGACACCAATATAACCCTCACAAACCCCTTGGGCAATAAATACT |
| | | AGTGTAGGAATGAAACATTCTGAATATCTTTAACAATAGAAATCCA |
| | | TGGGGTGGGGACAAGCCGTAAAGACTGGATGTCCATCTCACACGAA |
| | | TTTATGGCTATGGGCAACACATAATCCTAGTGCAATATGATACTGG |
| | | GGTTATTAAGATGTGTCCCAGGCAGGGACCAAGACAGGTGAACCAT |
| | | GTTGTTACACTCTATTTGTAACAAGGGGAAAGAGAGTGGACGCCGA |
| | | CAGCAGCGGACTCCACTGGTTGTCTCTAACACCCCCGAAAATTAAA |
| | | CGGGGCTCCACGCCAATGGGGCCCATAAACAAAGACAAGTGGCCAC |
| | | TCTTTTTTTTGAAATTGTGGAGTGGGGGCACGCGTCAGCCCCCACA |
| | | CGCCGCCCTGCGGTTTTGGACTGTAAAATAAGGGTGTAATAACTTG |
| | | GCTGATTGTAACCCCGCTAACCACTGCGGTCAAACCACTTGCCCAC |
| | | AAAACCACTAATGGCACCCCGGGGAATACCTGCATAAGTAGGTGGG |
| | | CGGGCCAAGATAGGGGCGCGATTGCTGCGATCTGGAGGACAAATTA |
| | | CACACACTTGCGCCTGAGCGCCAAGCACAGGGTTGTTGGTCCTCAT |
| | | ATTCACGAGGTCGCTGAGAGCACGGTGGGCTAATGTTGCCATGGGT |
| | | AGCATATACTACCCAAATATCTGGATAGCATATGCTATCCTAATCT |
| | | ATATCTGGGTAGCATAGGCTATCCTAATCTATATCTGGGTAGCATA |
| | | TGCTATCCTAATCTATATCTGGGTAGTATATGCTATCCTAATTTAT |
| | | ATCTGGGTAGCATAGGCTATCCTAATCTATATCTGGGTAGCATATG |
| | | CTATCCTAATCTATATCTGGGTAGTATATGCTATCCTAATCTGTAT |
| | | CCGGGTAGCATATGCTATCCTAATAGAGATTAGGGTAGTATATGCT |
| | | ATCCTAATTTATATCTGGGTAGCATATACTACCCAAATATCTGGAT |
| | | AGCATATGCTATCCTAATCTATATCTGGGTAGCATATGCTATCCTA |
| | | ATCTATATCTGGGTAGCATAGGCTATCCTAATCTATATCTGGGTAG |
| | | CATATGCTATCCTAATCTATATCTGGGTAGTATATGCTATCCTAAT |
| | | TTATATCTGGGTAGCATAGGCTATCCTAATCTATATCTGGGTAGCA |
| | | TATGCTATCCTAATCTATATCTGGGTAGTATATGCTATCCTAATCT |
| | | GTATCCGGGTAGCATATGCTATCCTCATGATAAGCTGTCAAACATG |
| | | AGAATTTTCTTGAAGACGAAAGGGCCTCGTGATACGCCTATTTTTA |
| | | TAGGTTAATGTCATGATAATAATGGTTTCTTAGACGTCAGGTGGCA |
| | | CTTTTCGGGGAAATGTGCGCGGAACCCCTATTTGTTTATTTTTCTA |
| | | AATACATTCAAATATGTATCCGCTCATGAGACAATAACCCTGATAA |
| | | ATGCTTCAATAATATTGAAAAAGGAAGAGTATGAGTATTCAACATT |
| | | TCCGTGTCGCCCTTATTCCCTTTTTTGCGGCATTTTGCCTTCCTGT |
| | | TTTTGCTCACCCAGAAACGCTGGTGAAAGTAAAAGATGCTGAAGAT |
| | | CAGTTGGGTGCACGAGTGGGTTACATCGAACTGGATCTCAACAGCG |
| | | GTAAGATCCTTGAGAGTTTTCGCCCCGAAGAACGTTTTCCAATGAT |
| | | GAGCACTTTTAAAGTTCTGCTATGTGGCGCGGTATTATCCCGTGTT |
| | | GACGCCGGGCAAGAGCAACTCGGTCGCCGCATACACTATTCTCAGA |
| | | ATGACTTGGTTGAGTACTCACCAGTCACAGAAAAGCATCTTACGGA |
| | | TGGCATGACAGTAAGAGAATTATGCAGTGCTGCCATAACCATGAGT |
| | | GATAACACTGCGGCCAACTTACTTCTGACAACGATCGGAGGACCGA |
| | | AGGAGCTAACCGCTTTTTTGCACAACATGGGGGATCATGTAACTCG |
| | | CCTTGATCGTTGGGAACCGGAGCTGAATGAAGCCATACCAAACGAC |
| | | GAGCGTGACACCACGATGCCTGCAGCAATGGCAACAACGTTGCGCA |
| | | AACTATTAACTGGCGAACTACTTACTCTAGCTTCCCGGCAACAATT |
| | | AATAGACTGGATGGAGGCGGATAAAGTTGCAGGACCACTTCTGCGC |
| | | TCGGCCCTTCCGGCTGGCTGGTTTATTGCTGATAAATCTGGAGCCG |
| | | GTGAGCGTGGGTCTCGCGGTATCATTGCAGCACTGGGGCCAGATGG |
| | | TAAGCCCTCCCGTATCGTAGTTATCTACACGACGGGGAGTCAGGCA |
| | | ACTATGGATGAACGAAATAGACAGATCGCTGAGATAGGTGCCTCAC |
| | | TGATTAAGCATTGGTAACTGTCAGACCAAGTTTACTCATATATACT |
| | | TTAGATTGATTTAAAACTTCATTTTTAATTTAAAAGGATCTAGGTG |
| | | AAGATCCTTTTTGATAATCTCATGACCAAAATCCCTTAACGTGAGT |
| | | TTTCGTTCCACTGAGCGTCAGACCCCGTAGAAAAGATCAAAGGATC |
| | | TTCTTGAGATCCTTTTTTTCTGCGCGTAATCTGCTGCTTGCAAACA |
| | | AAAAAACCACCGCTACCAGCGGTGGTTTGTTTGCCGGATCAAGAGC |
| | | TACCAACTCTTTTTCCGAAGGTAACTGGCTTCAGCAGAGCGCAGAT |
| | | ACCAAATACTGTTCTTCTAGTGTAGCCGTAGTTAGGCCACCACTTC |
| | | AAGAACTCTGTAGCACCGCCTACATACCTCGCTCTGCTAATCCTGT |
| | | TACCAGTGGCTGCTGCCAGTGGCGATAAGTCGTGTCTTACCGGGTT |
| | | GGACTCAAGACGATAGTTACCGGATAAGGCGCAGCGGTCGGGCTGA |
| | | ACGGGGGGTTCGTGCACACAGCCCAGCTTGGAGCGAACGACCTACA |
| | | CCGAACTGAGATACCTACAGCGTGAGCTATGAGAAAGCGCCACGCT |
| | | TCCCGAAGGGAGAAAGGCGGACAGGTATCCGGTAAGCGGCAGGGTC |
| | | GGAACAGGAGAGCGCACGAGGGAGCTTCAGGGGGAAACGCCTGGT |
| | | ATCTTTATAGTCCTGTCGGGTTTCGCCACCTCTGACTTGAGCGTCG |
| | | ATTTTTGTGATGCTCGTCAGGGGGCGGAGCCTATGGAAAAACGCC |
| | | AGCAACGCGGCCTTTTTACGGTTCCTGGCCTTTTGCTGGCCTTTTG |
| | | CTCACATGTTCTTTCCTGCGTTATCCCCTGATTCTGTGGATAACCG |
| | | TATTACCGCCTTTGAGTGAGCTGATACCGCTCGCCGCAGCCGAACG |
| | | ACCGAGCGCAGCGAGTCAGTGAGCGAGGAAGCGGAAGAGCGCCCAA |
| | | TACGCAAACCGCCTCTCCCCGCGCGTTGGCCGATTCATTAATGCAG |
| | | CTGGCACGACAGGTTTCCCGACTGGAAAGCGGGCAGTGAGCGCAAC |
| | | GCAATTAATGTGAGTTAGCTCACTCATTAGGCACCCCAGGCTTTAC |
| | | ACTTTATGCTTCCGGCTCGTATGTTGTGTGGAATTGTGAGCGGATA |

TABLE 74-continued

Nucleotide sequences
Vector SEQ ID 123456789012345678901234567890123456789012345 6
name   NO   78901

```
ACAATTTCACACAGGAAACAGCTATGACCATGATTACGCCAAGCTC
TAGCTAGAGGTCGAGTCCCTCCCCAGCAGGCAGAAGTATGCAAAGC
ATGCATCTCAATTAGTCAGCAACCATAGTCCCGCCCCTAACTCCGC
CCATCCCGCCCCTAACTCCGCCCAGTTCCGCCCATTCTCCGCCCCA
TGGCTGACTAATTTTTTTATTTATGCAGAGGCCGAGGCCGCCTCG
GCCTCTGAGCTATTCCAGAAGTAGTGAGGAGGCTTTTTTGGAGGCC
TAGGCTTTTGCAAAAAGCTTTGCAAAGATGGATAAAGTTTTAAACA
GAGAGGAATCTTTGCAGCTAATGGACCTTCTAGGTCTTGAAAGGAG
TGGGAATTGGCTCCGGTGCCCGTCAGTGGGCAGAGCGCACATCGCC
CACAGTCCCCGAGAAGTTGGGGGGAGGGGTCGGCAATTGAACCGGT
GCCTAGAGAAGGTGGCGCGGGGTAAACTGGGAAAGTGATGTCGTGT
ACTGGCTCCGCCTTTTTCCCGAGGGTGGGGGAGAACCGTATATAAG
TGCAGTAGTCGCCGTGAACGTTCTTTTTCGCAACGGGTTTGCCGCC
AGAACACAGGTAAGTGCCGTGTGTGGTTCCCGCGGGCCTGGCCTCT
TTACGGGTTATGCCCTTGCGTGCCTTGAATTACTTCCACCTGGCT
GCAGTACGTGATTCTTGATCCCGAGCTTCGGGTTGGAAGTGGGTGG
GAGAGTTCGAGGCCTTGCGCTTAAGGAGCCCCTTCGCCTCGTGCTT
GAGTTGAGGCCTGGCCTGGGCGCTGGGGCCGCCGCGTGCGAATCTG
GTGGCACCTTCGCGCCTGTCTCGCTGCTTTCGATAAGTCTCTAGCC
ATTTAAAATTTTTGATGACCTGCTGCGACGCTTTTTTTCTGGCAAG
ATAGTCTTGTAAATGCGGGCCAAGATCTGCACACTGGTATTTCGGT
TTTTGGGGCCGCGGGCGGCGACGGGGCCCGTGCGTCCCAGCGCACA
TGTTCGGCGAGGCGGGGCCTGCGAGCGCGGCCACCGAGAATCGGAC
GGGGGTAGTCTCAAGCTGGCCGGCCTGCTCTGGTGCCTGGCCTCGC
GCCGCCGTGTATCGCCCCGCCCTGGGCGGCAAGGCTGGCCCGGTCG
GCACCAGTTGCGTGAGCGGAAAGATGGCCGCTTCCCGGCCCTGCTG
CAGGGAGCTCAAAATGGAGGACGCGGCGCTCGGGAGAGCGGGCGGG
TGAGTCACCCACACAAAGGAAAAGGGCCTTTCCGTCCTCAGCCGTC
GCTTCATGTGACTCCACGGAGTACCGGGCGCCGTCCAGGCACCTCG
ATTAGTTCTCGAGCTTTTGGAGTACGTCGTCTTTAGGTTGGGGGGA
GGGGTTTTATGCGATGGAGTTTCCCCACACTGAGTGGGTGGAGACT
GAAGTTAGGCCAGCTTGGCACTTGATGTAATTCTCCTTGGAATTTG
CCCTTTTTGAGTTTGGATCTTGGTTCATTCTCAAGCCTCAGACAGT
GGTTCAAAGTTTTTTTCTTCCATTTCAGGTGTCGTGAGGAATTCTC
TAGAGATCCCTCGACCTCGAGATCCATTGTGCCCGGGCGCCACCAT
GGAGTTTGGGCTGAGCTGGCTTTTTCTTGTCGCGATTTTAAAAGGT
GTCCAGTGC
```

The present disclosure incorporates by reference in their entirety techniques well known in the field of molecular biology and drug delivery. These techniques include, but are not limited to, techniques described in the following publications:

Ausubel et al. (eds.), Current Protocols in Molecular Biology, John Wiley & Sons, NY (1993);

Ausubel et al. (eds.), Short Protocols In Molecular Biology, John Wiley & Sons, NY (4th edition, 1999) (ISBN 0-471-32938-X);

Giege, R. and Ducruix, A. Barrett, Crystallization of Nucleic Acids and Proteins, a Practical Approach, 2nd ea., pp. 20 1-16, Oxford University Press, New York, N.Y., (1999);

Goodson, in Medical Applications of Controlled Release, vol. 2, pp. 115-138 (1984);

Hammerling et al., in: Monoclonal Antibodies and T-Cell Hybridomas 563-681 (Elsevier, N.Y., 1981;

Harlow et al., Antibodies: A Laboratory Manual, (Cold Spring Harbor Laboratory Press, 2nd ed. 1988);

Kabat et al., Sequences of Proteins of Immunological Interest (National Institutes of Health, Bethesda, Md. (1987) and (1991);

Kabat, E. A., et al. (1991) Sequences of Proteins of Immunological Interest, Fifth Edition, U.S. Department of Health and Human Services, NIH Publication No. 91-3242;

Kontermann and Dubel eds., Antibody Engineering (2001) Springer-Verlag. New York. 790 pp. (ISBN 3-540-41354-5);

Kriegler, Gene Transfer and Expression, A Laboratory Manual, Stockton Press, NY (1990);

Langer and Wise (eds.), Medical Applications of Controlled Release, CRC Press, Boca Raton, Fla. (1974);

Lu and Weiner eds., Cloning and Expression Vectors for Gene Function Analysis (2001) BioTechniques Press. Westborough, Mass. 298 pp. (ISBN 1-881299-21-X);

Old, R. W. & S. B. Primrose, Principles of Gene Manipulation: An Introduction To Genetic Engineering (3d Ed. 1985) Blackwell Scientific Publications, Boston. Studies in Microbiology; V.2:409 pp. (ISBN 0-632-01318-4);

Robinson, J. R. (ed.), Sustained and Controlled Release Drug Delivery Systems, Marcel Dekker, Inc., NY (1978);

Ruan, Q., Skinner, J. P. and Tetin, S. Y. Using non-fluorescent FRET acceptors in protein binding studies. Analyt. Biochemistry (2009), 393, 196-204;

Sambrook, J. et al. eds., Molecular Cloning: A Laboratory Manual (2d Ed. 1989) Cold Spring Harbor Laboratory Press, NY. Vols. 1-3. (ISBN 0-87969-309-6);

Smolen and Ball (eds.), Controlled Drug Bioavailability, Drug Product Design and Performance, John Wiley & Sons, NY (1984);

Winnacker, E. L. From Genes To Clones: Introduction To Gene Technology (1987) VCH Publishers, NY (translated by Horst lbelgaufts). 634 pp. (ISBN 0-89573-614-4).

INCORPORATION BY REFERENCE

The contents of all cited references (including literature references, patents, patent applications, databases and websites) that maybe cited throughout this application are hereby expressly incorporated by reference in their entirety for any purpose, as are the references cited therein. The practice of the present disclosure will employ, unless otherwise indicated, conventional techniques of immunology, molecular biology and cell biology, which are well known in the art.

EQUIVALENTS

The disclosure may be embodied in other specific forms without departing from the spirit or essential characteristics thereof. The foregoing embodiments are therefore to be considered in all respects illustrative rather than limiting. Scope is thus indicated by the appended claims rather than by the foregoing description, and all changes that come within the meaning and range of equivalency of the claims are therefore intended to be embraced herein.

SEQUENCE LISTING (295 sequences)

SEQ ID NO: 1 - protein, 16 aa, Artificial Sequence
  Description of Artificial Sequence: Synthetic peptide
AKTTPKLEEGEFSEAR

SEQ ID NO: 2 - protein, 17 aa, Artificial Sequence
  Description of Artificial Sequence: Synthetic peptide
AKTTPKLEEGEFSEARV

SEQ ID NO: 3 - protein, 9 aa, Artificial Sequence
  Description of Artificial Sequence: Synthetic peptide
AKTTPKLGG

SEQ ID NO: 4 - protein, 10 aa, Artificial Sequence
  Description of Artificial Sequence: Synthetic peptide
SAKTTPKLGG

SEQ ID NO: 5 - protein, 6 aa, Artificial Sequence
  Description of Artificial Sequence: Synthetic peptide
SAKTTP

SEQ ID NO: 6 - protein, 6 aa, Artificial Sequence
  Description of Artificial Sequence: Synthetic peptide
RADAAP

SEQ ID NO: 7 - protein, 9 aa, Artificial Sequence
  Description of Artificial Sequence: Synthetic peptide
RADAAPTVS

SEQ ID NO: 8 - protein, 12 aa, Artificial Sequence
  Description of Artificial Sequence: Synthetic peptide
RADAAAAGGPGS

SEQ ID NO: 9 - protein, 27 aa, Artificial Sequence
  Description of Artificial Sequence: Synthetic peptide
RADAAAAGGGGSGGGGSGGGGSGGGGS

SEQ ID NO: 10 - protein, 18 aa, Artificial Sequence
  Description of Artificial Sequence: Synthetic peptide
SAKTTPKLEEGEFSEARV

SEQ ID NO: 11 - protein, 5 aa, Artificial Sequence
  Description of Artificial Sequence: Synthetic peptide
ADAAP

SEQ ID NO: 12 - protein, 12 aa, Artificial Sequence
  Description of Artificial Sequence: Synthetic peptide
ADAAPTVSIFPP

SEQ ID NO: 13 - protein, 5 aa, Artificial Sequence
  Description of Artificial Sequence: Synthetic peptide
TVAAP

SEQ ID NO: 14 - protein, 12 aa, Artificial Sequence
  Description of Artificial Sequence: Synthetic peptide
TVAAPSVFIFPP

SEQ ID NO: 15 - protein, 6 aa, Artificial Sequence
  Description of Artificial Sequence: Synthetic peptide
QPKAAP

SEQ ID NO: 16 - protein, 13 aa, Artificial Sequence
  Description of Artificial Sequence: Synthetic peptide
QPKAAPSVTLFPP

SEQ ID NO: 17 - protein, 6 aa, Artificial Sequence
  Description of Artificial Sequence: Synthetic peptide
AKTTPP

SEQ ID NO: 18 - protein, 13 aa, Artificial Sequence
  Description of Artificial Sequence: Synthetic peptide
AKTTPPSVTPLAP

SEQ ID NO: 19 - protein, 6 aa, Artificial Sequence
  Description of Artificial Sequence: Synthetic peptide
AKTTAP

SEQ ID NO: 20 - protein, 13 aa, Artificial Sequence
  Description of Artificial Sequence: Synthetic peptide
AKTTAPSVYPLAP

SEQ ID NO: 21 - protein, 6 aa, Artificial Sequence
  Description of Artificial Sequence: Synthetic peptide
ASTKGP

SEQ ID NO: 22 - protein, 13 aa, Artificial Sequence
  Description of Artificial Sequence: Synthetic peptide
ASTKGPSVFPLAP

SEQ ID NO: 23 - protein, 15 aa, Artificial Sequence
  Description of Artificial Sequence: Synthetic peptide
GGGGSGGGGSGGGGS

SEQ ID NO: 24 - protein, 15 aa, Artificial Sequence
  Description of Artificial Sequence: Synthetic peptide
GENKVEYAPALMALS

SEQ ID NO: 25 - protein, 15 aa, Artificial Sequence
  Description of Artificial Sequence: Synthetic peptide
GPAKELTPLKEAKVS

SEQ ID NO: 26 - protein, 15 aa, Artificial Sequence
  Description of Artificial Sequence: Synthetic peptide
GHEAAAVMQVQYPAS

SEQ ID NO: 27 - protein, 24 aa, Artificial Sequence
  Description of Artificial Sequence: Synthetic peptide
TVAAPSVFIFPPTVAAPSVFIFPP

SEQ ID NO: 28 - protein, 26 aa, Artificial Sequence
  Description of Artificial Sequence: Synthetic peptide
ASTKGPSVFPLAPASTKGPSVFPLAP

SEQ ID NO: 29 - protein, 5 aa, Artificial Sequence
  Description of Artificial Sequence: Synthetic peptide
GGGGS

SEQ ID NO: 30 - protein, 119 aa, Artificial Sequence
  Description of Artificial Sequence: Synthetic polypeptide
EVQLVESGGGVVQPGRSLRLSCSASGFIFSRYDMSWVRQAPGKGLEWVAYISHGGAGTYYPDSVKGRFTISRDNSKNTLFLQMDSLRPEDTGVYFCARGGVTKGYFDVWGQGTPVTVSS

SEQ ID NO: 31 - protein, 108 aa, Artificial Sequence
  Description of Artificial Sequence: Synthetic polypeptide
DIQMTQSPSSLSASVGDRVTITCRASGNIHNYLTWYQQTPGKAPKLLIYNAKTLADGVPSRFSGSGSGTDYTFTISSLQPEDIATYYCQHFWSIPYTFGQGTKLQITR

SEQ ID NO: 32 - protein, 119 aa, Artificial Sequence
  Description of Artificial Sequence: Synthetic polypeptide
EVQLVESGGGVVQPGRSLRLSCSASGFIFSRYDMSWVRQAPGKGLEWVAYISHGGAGTYYPDSVKGRFTISRDNSKNTLFLQMDSLRAEDTAVYYCARGGVYKGYFDVWGQGTPVTVSS

SEQ ID NO: 33 - protein, 108 aa, Artificial Sequence; identical to SEQ ID NO: 31
  Description of Artificial Sequence: Synthetic polypeptide

SEQ ID NO: 34 - protein, 122 aa, Artificial Sequence
  Description of Artificial Sequence: Synthetic polypeptide
EVQLQESGPGLVKPSETLSLTCTVSGFSLSDYGVSWIRQPPGKGLEWLGLIWGGGDTYYNSPLKSRLTISKDNSKSQVSLKLSSVTAADTAVYYCAKQRTLWGYDLYGMDYWGQGTLVTVSS

SEQ ID NO: 35 - protein, 108 aa, Artificial Sequence
  Description of Artificial Sequence: Synthetic polypeptide
DTQVTQSPSSLSASVGDRVTITCITSTDIDVDMNWYQQKPGKPPKLLISQGNTLRPGVPSRFSSSGSGTDFTFTISSLQPEDFATYYCLQSDNLPLTFGQGTKLEIKR

SEQ ID NO: 36 - protein, 122 aa, Artificial Sequence; identical to SEQ ID NO: 34
  Description of Artificial Sequence: Synthetic polypeptide

SEQ ID NO: 37 - protein, 108 aa, Artificial Sequence
  Description of Artificial Sequence: Synthetic polypeptide
DTVVTQSPAFLSVTPGEKVTITCITSTDIDVDMNWYQQKPDQPPKLLISQGNTLRPGVPSRFSSSGSGTDFTFTISSLEAEDAATYYCLQSDNLPLTFGQGTKLEIKR

SEQ ID NO: 38 - protein, 122 aa, Artificial Sequence
  Description of Artificial Sequence: Synthetic polypeptide
EVQLVESGGGLVQPGGSLRLSCAVSGFTLSDYGVSWIRQAPGKGLEWLGLIWGGGDTYYNSPLKSRLTISKDNSKSTVYLQMNSLRAEDTAVYYCAKQRTLWGYDLYGMDYWGQGTLVTVSS

SEQ ID NO: 39 - protein, 108 aa, Artificial Sequence
  Description of Artificial Sequence: Synthetic polypeptide
ETTVTQSPSSLSASVGDRVTITCITSTDIDVDMNWYQQKPGKPPKLLISQGNTLRPGVPSRFSSSGSGTDFTFTISSLQPEDFATYYCLQSDNLPLTFGQGTKLEIKR

SEQ ID NO: 40 - protein, 121 aa, Artificial Sequence
  Description of Artificial Sequence: Synthetic polypeptide
EVQLVQSGAEVKKPGSSVKVSCKASGYTFTDYEIHWVRQAPGQGLEWMGVNDPESGGTFYNQKFDGRVTLTADESTSTAYMELSSLRSEDTAVYYCTRYSKWDSFDGMDYWGQGTTVTVSS

SEQ ID NO: 41 - protein, 108 aa, Artificial Sequence
  Description of Artificial Sequence: Synthetic polypeptide
DIQMTQSPSSLSASVGDRVTITCRASSGIISYIDWFQQKPGKAPKRLIYATFDLASGVPSRFSGSGSGTDYTLTISSLQPEDFATYYCRQVGSYPETFGQGTKLEIKR

SEQ ID NO: 42 - protein, 126 aa, Artificial Sequence
  Description of Artificial Sequence: Synthetic polypeptide
EVQLVQSGAEVKKPGSSVKVSCKASGGSFGGYGIGWVRQAPGQGLEWMGGITPFFGFADYAQKFQGRVTITADESTTTAYMELSGLTSDDTAVYYCARDPNEFWNGYYSTHDFDSWGQGTTVTVSS

SEQ ID NO: 43 - protein, 108 aa, Artificial Sequence
  Description of Artificial Sequence: Synthetic polypeptide
EIVLTQSPDFQSVTPKEKVTITCRASQDIGSELHWYQQKPDQPPKLLIKYASHSTSGVPSRFSGSGSGTDFTLTINGLEAEDAGTYYCHQTDSLPYTFGPGTKVDIKR

SEQ ID NO: 44 - protein, 126 aa, Artificial Sequence
  Description of Artificial Sequence: Synthetic polypeptide
EVQLVQSGAEVKKPGESVKISCKASGGSFRSYGISWVRQAPGQGLEWMGGITHFFGITDYAQKFQGRVTITADESTTTAYMELSGLTSDDTAVYYCAREPNDFWNGYYDTHDFDSWGQGTTVTVSS

SEQ ID NO: 45 - protein, 108 aa, Artificial Sequence
  Description of Artificial Sequence: Synthetic polypeptide
EIVLTQSPDFQSVTPKEKVTITCRASQNIGSELHWYQQKPDQSPKLLIKYASHSISGVPSRFSGSGSGTDFTLTINGLEAEDAATYYCHQSDTLPHTFGQGTKVDIKR

SEQ ID NO: 46 - protein, 330 aa, Homo sapiens
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 47 - protein, 330 aa, Homo sapiens
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 48 - protein, 106 aa, Homo sapiens
TVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 49 - protein, 105 aa, Homo sapiens
QPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 50 - protein, 246 aa, Artificial Sequence
  Description of Artificial Sequence: Synthetic polypeptide
EVQLVESGGGVVQPGRSLRLSCSASGFIFSRYDMSWVRQAPGKGLEWVAYISHGGAGTYYPDSVKGRFTISRDNSKNTLFLQMDSLRPEDTGVYFCARGGVTKGYFDVWGQGTPVTVSSASTKGPEVQLVQSGAEVKKPGSSVKVSCKASGYTFTDYEIHWVRQAPGQGLEWMGVNDPESGGTFYNQKFDGRVTLTADESTSTAYMELSSLRSEDTAVYYCTRYSKWDSFDGMDYWGQGTTVTVSS

SEQ ID NO: 51 - protein, 221 aa, Artificial Sequence
  Description of Artificial Sequence: Synthetic polypeptide
DIQMTQSPSSLSASVGDRVTITCRASGNIHNYLTWYQQTPGKAPKLLIYNAKTLADGVPSRFSGSGSGTDYTFTISSLQPEDIATYYCQHFWSIPYTFGQGTKLQITRTVAAPDIQMTQSPSSLSASVGDRVTITCRASSGIISYIDWFQQKPGKAPKRLIYATFDLASGVPSRFSGSGSGTDYTLTISSLQPEDFATYYCRQVGSYPETFGQGTKLEIKR

SEQ ID NO: 52 - protein, 246 aa, Artificial Sequence
  Description of Artificial Sequence: Synthetic polypeptide
EVQLVQSGAEVKKPGSSVKVSCKASGYTFTDYEIHWVRQAPGQGLEWMGVNDPESGGTFYNQKFDGRVTLTADESTSTAYMELSSLRSEDTAVYYCTRYSKWDSFDGMDYWGQGTTVTVSSASTKGPEVQLVESGGGVVQPGRSLRLSCSASGFIFSRYDMSWVRQAPGKGLEWVAYISHGGAGTYYPDSVKGRFTISRDNSKNTLFLQMDSLRPEDTGVYFCARGGVTKGYFDVWGQGTPVTVSS

SEQ ID NO: 53 - protein, 221 aa, Artificial Sequence
  Description of Artificial Sequence: Synthetic polypeptide
DIQMTQSPSSLSASVGDRVTITCRASSGIISYIDWFQQKPGKAPKRLIYATFDLASGVPSRFSGSGSGTDYTLTISSLQPEDFATYYCRQVGSYPETFGQGTKLEIKRTVAAPDIQMTQSPSSLSASVGDRVTITCRASGNIHNYLTWYQQTPGKAPKLLIYNAKTLADGVPSRFSGSGSGTDYTFTISSLQPEDIATYYCQHFWSIPYTFGQGTKLQITR

SEQ ID NO: 54 - protein, 246 aa, Artificial Sequence
  Description of Artificial Sequence: Synthetic polypeptide
EVQLVESGGGVVQPGRSLRLSCSASGFIFSRYDMSWVRQAPGKGLEWVAYISHGGAGTYYPDSVKGRFTISRDNSKNTLFLQMDSLRAEDTAVYYCARGGVYKGYFDVWGQGTPVTVSSASTKGPEVQLVQSGAEVKKPGSSVKVSCKASGYTFTDYEIHWVRQAPGQGLEWMGVNDPESGGTFYNQKFDGRVTLTADESTSTAYMELSSLRSEDTAVYYCTRYSKWDSFDGMDYWGQGTTVTVSS

SEQ ID NO: 55 - protein, 221 aa, Artificial Sequence; identical to SEQ ID NO: 51
  Description of Artificial Sequence: Synthetic polypeptide

SEQ ID NO: 56 - protein, 246 aa, Artificial Sequence
  Description of Artificial Sequence: Synthetic polypeptide
EVQLVQSGAEVKKPGSSVKVSCKASGYTFTDYEIHWVRQAPGQGLEWMGVNDPESGGTFYNQKFDGRVTLTADESTSTAYMELSSLRSEDTAVYYCTRYSKWDSFDGMDYWGQGTTVTVSSASTKGPEVQLVESGGGVVQPGRSLRLSCSASGFIFSRYDMSWVRQAPGKGLEWVAYISHGGAGTYYPDSVKGRFTISRDNSKNTLFLQMDSLRAEDTAVYYCARGGVYKGYFDVWGQGTPVTVSS

SEQ ID NO: 57 - protein, 221 aa, Artificial Sequence; identical to SEQ ID NO: 53
  Description of Artificial Sequence: Synthetic polypeptide

SEQ ID NO: 58 - protein, 249 aa, Artificial Sequence
  Description of Artificial Sequence: Synthetic polypeptide
EVQLQESGPGLVKPSETLSLTCTVSGFSLSDYGVSWIRQPPGKGLEWLGLIWGGGDTYYNSPLKSRLTISKDNSKSQVSLKLSSVTAADTAVYYCAKQRTLWGYDLYGMDYWGQGTLVTVSSASTKGPEVQLVQSGAEVKKPGSSVKVSCKASGYTFTDYEIHWVRQAPGQGLEWMGVNDPESGGTFYNQKFDGRVTLTADESTSTAYMELSSLRSEDTAVYYCTRYSKWDSFDGMDYWGQGTTVTVSS

SEQ ID NO: 59 - protein, 221 aa, Artificial Sequence
  Description of Artificial Sequence: Synthetic polypeptide
DTQVTQSPSSLSASVGDRVTITCITSTDIDVDMNWYQQKPGKPPKLLISQGNTLRPGVPSRFSSSGSGTDFTFTISSLQPEDFATYYCLQSDNLPLTFGQGTKLEIKRTVAAPDIQMTQSPSSLSASVGDRVTITCRASSGIISYIDWFQQKPGKAPKRLIYATFDLASGVPSRFSGSGSGTDYTLTISSLQPEDFATYYCRQVGSYPETFGQGTKLEIKR

SEQ ID NO: 60 - protein, 249 aa, Artificial Sequence
  Description of Artificial Sequence: Synthetic polypeptide
EVQLVQSGAEVKKPGSSVKVSCKASGYTFTDYEIHWVRQAPGQGLEWMGVNDPESGGTFYNQKFDGRVTLTADESTSTAYMELSSLRSEDTAVYYCTRYSKWDSFDGMDYWGQGTTVTVSSASTKGPEVQLQESGPGLVKPSETLSLTCTVSGFSLSDYGVSWIRQPPGKGLEWLGLIWGGGDTYYNSPLKSRLTISKDNSKSQVSLKLSSVTAADTAVYYCAKQRTLWGYDLYGMDYWGQGTLVTVSS

SEQ ID NO: 61 - protein, 221 aa, Artificial Sequence
  Description of Artificial Sequence: Synthetic polypeptide
DIQMTQSPSSLSASVGDRVTITCRASSGIISYIDWFQQKPGKAPKRLIYATFDLASGVPSRFSGSGSGTDYTLTISSLQPEDFATYYCRQVGSYPETFGQGTKLEIKRTVAAPDTQVTQSPSSLSASVGDRVTITCITSTDIDVDMNWYQQKPGKPPKLLISQGNTLRPGVPSRFSSSGSGTDFTFTISSLQPEDFATYYCLQSDNLPLTFGQGTKLEIKR

SEQ ID NO: 62 - protein, 249 aa, Artificial Sequence; identical to SEQ ID NO: 58
  Description of Artificial Sequence: Synthetic polypeptide

SEQ ID NO: 63 - protein, 221 aa, Artificial Sequence
  Description of Artificial Sequence: Synthetic polypeptide
DTVVTQSPAFLSVTPGEKVTITCITSTDIDVDMNWYQQKPDQPPKLLISQGNTLRPGVPSRFSSSGSGTDFTFTISSLEAEDAATYYCLQSDNLPLTFGQGTKLEIKRTVAAPDIQMTQSPSSLSASVGDRVTITCRASSGIISYIDWFQQKPGKAPKRLIYATFDLASGVPSRFSGSGSGTDYTLTISSLQPEDFATYYCRQVGSYPETFGQGTKLEIKR

SEQ ID NO: 64 - protein, 249 aa, Artificial Sequence; identical to SEQ ID NO: 60
  Description of Artificial Sequence: Synthetic polypeptide

SEQ ID NO: 65 - protein, 221 aa, Artificial Sequence
  Description of Artificial Sequence: Synthetic polypeptide
DIQMTQSPSSLSASVGDRVTITCRASSGIISYIDWFQQKPGKAPKRLIYATFDLASGVPSRFSGSGSGTDYTLTISSLQPEDFATYYCRQVGSYPETFGQGTKLEIKRTVAAPDTVVTQSPAFLSVTPGEKVTITCITSTDIDVDMNWYQQKPDQPPKLLISQGNTLRPGVPSRFSSSGSGTDFTFTISSLEAEDAATYYCLQSDNLPLTFGQGTKLEIKR

SEQ ID NO: 66 - protein, 249 aa, Artificial Sequence
  Description of Artificial Sequence: Synthetic polypeptide
EVQLVESGGGLVQPGGSLRLSCAVSGFTLSDYGVSWIRQAPGKGLEWLGLIWGGGDTYYNSPLKSRLTISKDNSKSTVYLQMNSLRAEDTAVYYCAKQRTLWGYDLYGMDYWGQGTLVTVSSASTKGPEVQLVQSGAEVKKPGSSVKVSCKASGYTFTDYEIHWVRQAPGQGLEWMGVNDPESGGTFYNQKFDGRVTLTADESTSTAYMELSSLRSEDTAVYYCTRYSKWDSFDGMDYWGQGTTVTVSS

SEQ ID NO: 67 - protein, 221 aa, Artificial Sequence
  Description of Artificial Sequence: Synthetic polypeptide
ETTVTQSPSSLSASVGDRVTITCITSTDIDVDMNWYQQKPGKPPKLLISQGNTLRPGVPSRFSSSGSGTDFTFTISSLQPEDFATYYCLQSDNLPLTFGQGTKLEIKRTVAAPDIQMTQSPSSLSASVGDRVTITCRASSGIISYIDWFQQKPGKAPKRLIYATFDLASGVPSRFSGSGSGTDYTLTISSLQPEDFATYYCRQVGSYPETFGQGTKLEIKR

SEQ ID NO: 68 - protein, 249 aa, Artificial Sequence
  Description of Artificial Sequence: Synthetic polypeptide
EVQLVQSGAEVKKPGSSVKVSCKASGYTFTDYEIHWVRQAPGQGLEWMGVNDPESGGTFYNQKFDGRVTLTADESTSTAYMELSSLRSEDTAVYYCTRYSKWDSFDGMDYWGQGTTVTVSSASTKGPEVQLVESGGGLVQPGGSLRLSCAVSGFTLSDYGVSWIRQAPGKGLEWLGLIWGGGDTYYNSPLKSRLTISKDNSKSTVYLQMNSLRAEDTAVYYCAKQRTLWGYDLYGMDYWGQGTLVTVSS

SEQ ID NO: 69 - protein, 221 aa, Artificial Sequence
  Description of Artificial Sequence: Synthetic polypeptide
DIQMTQSPSSLSASVGDRVTITCRASSGIISYIDWFQQKPGKAPKRLIYATFDLASGVPSRFSGSGSGTDYTLTISSLQPEDFATYYCRQVGSYPETFGQGTKLEIKRTVAAPETTVTQSPSSLSASVGDRVTITCITSTDIDVDMNWYQQKPGKPPKLLISQGNTLRPGVPSRFSSSGSGTDFTFTISSLQPEDFATYYCLQSDNLPLTFGQGTKLEIKR

SEQ ID NO: 70 - protein, 251 aa, Artificial Sequence
  Description of Artificial Sequence: Synthetic polypeptide
EVQLVESGGGVVQPGRSLRLSCSASGFIFSRYDMSWVRQAPGKGLEWVAYISHGGAGTYYPDSVKGRFTISRDNSKNTLFLQMDSLRPEDTGVYFCARGGVTKGYFDVWGQGTPVTVSSASTKGPEVQLVQSGAEVKKPGSSVKVSCKASGGSFGGYGIGWVRQAPGQGLEWMGGITPFFGFADYAQKFQGRVTITADESTTTAYMELSGLTSDDTAVYYCARDPNEFWNGYYSTHDFDSWGQGTTVTVSS

SEQ ID NO: 71 - protein, 221 aa, Artificial Sequence
  Description of Artificial Sequence: Synthetic polypeptide
DIQMTQSPSSLSASVGDRVTITCRASGNIHNYLTWYQQTPGKAPKLLIYNAKTLADGVPSRFSGSGSGTDYTFTISSLQPEDIATYYCQHFWSIPYTFGQGTKLQITRTVAAPEIVLTQSPDFQSVTPKEKVTITCRASQDIGSELHWYQQKPDQPPKLLIKYASHSTSGVPSRFSGSGSGTDFTLTINGLEAEDAGTYYCHQTDSLPYTFGPGTKVDIKR

SEQ ID NO: 72 - protein, 251 aa, Artificial Sequence
  Description of Artificial Sequence: Synthetic polypeptide
EVQLVQSGAEVKKPGSSVKVSCKASGGSFGGYGIGWVRQAPGQGLEWMGGITPFFGFADYAQKFQGRVTITADESTTTAYMELSGLTSDDTAVYYCARDPNEFWNGYYSTHDFDSWGQGTTVTVSSASTKGPEVQLVESGGGVVQPGRSLRLSCSASGFIFSRYDMSWVRQAPGKGLEWVAYISHGGAGTYYPDSVKGRFTISRDNSKNTLFLQMDSLRPEDTGVYFCARGGVTKGYFDVWGQGTPVTVSS

SEQ ID NO: 73 - protein, 221 aa, Artificial Sequence
  Description of Artificial Sequence: Synthetic polypeptide
EIVLTQSPDFQSVTPKEKVTITCRASQDIGSELHWYQQKPDQPPKLLIKYASHSTSGVPSRFSGSGSGTDFTLTINGLEAEDAGTYYCHQTDSLPYTFGPGTKVDIKRTVAAPDIQMTQSPSSLSASVGDRVTITCRASGNIHNYLTWYQQTPGKAPKLLIYNAKTLADGVPSRFSGSGSGTDYTFTISSLQPEDIATYYCQHFWSIPYTFGQGTKLQITR

SEQ ID NO: 74 - protein, 251 aa, Artificial Sequence
  Description of Artificial Sequence: Synthetic polypeptide
EVQLVESGGGVVQPGRSLRLSCSASGFIFSRYDMSWVRQAPGKGLEWVAYISHGGAGTYYPDSVKGRFTISRDNSKNTLFLQMDSLRAEDTAVYYCARGGVYKGYFDVWGQGTPVTVSSASTKGPEVQLVQSGAEVKKPGSSVKVSCKASGGSFGGYGIGWVRQAPGQGLEWMGGITPFFGFADYAQKFQGRVTITADESTTTAYMELSGLTSDDTAVYYCARDPNEFWNGYYSTHDFDSWGQGTTVTVSS

SEQ ID NO: 75 - protein, 221 aa, Artificial Sequence; identical to SEQ ID NO: 71
  Description of Artificial Sequence: Synthetic polypeptide

SEQ ID NO: 76 - protein, 251 aa, Artificial Sequence
  Description of Artificial Sequence: Synthetic polypeptide
EVQLVQSGAEVKKPGSSVKVSCKASGGSFGGYGIGWVRQAPGQGLEWMGGITPFFGFADYAQKFQGRVTITADESTTTAYMELSGLTSDDTAVYYCARDPNEFWNGYYSTHDFDSWGQGTTVTVSSASTKGPEVQLVESGGGVVQPGRSLRLSCSASGFIFSRYDMSWVRQAPGKGLEWVAYISHGGAGTYYPDSVKGRFTISRDNSKNTLFLQMDSLRAEDTAVYYCARGGVYKGYFDVWGQGTPVTVSS

SEQ ID NO: 77 - protein, 221 aa, Artificial Sequence; identical to SEQ ID NO: 73
  Description of Artificial Sequence: Synthetic polypeptide

SEQ ID NO: 78 - protein, 254 aa, Artificial Sequence
  Description of Artificial Sequence: Synthetic polypeptide
EVQLQESGPGLVKPSETLSLTCTVSGFSLSDYGVSWIRQPPGKGLEWLGLIWGGGDTYYNSPLKSRLTISKDNSKSQVSLKLSSVTAADTAVYYCAKQRTLWGYDLYGMDYWGQGTLVTVSSASTKGPEVQLVQSGAEVKKPGSSVKVSCKASGGSFGGYGIGWVRQAPGQGLEWMGGITPFFGFADYAQKFQGRVTITADESTTTAYMELSGLTSDDTAVYYCARDPNEFWNGYYSTHDFDSWGQGTTVTVSS

SEQ ID NO: 79 - protein, 221 aa, Artificial Sequence
  Description of Artificial Sequence: Synthetic polypeptide
DTQVTQSPSSLSASVGDRVTITCITSTDIDVDMNWYQQKPGKPPKLLISQGNTLRPGVPSRFSSSGSGTDFTFTISSLQPEDFATYYCLQSDNLPLTFGQGTKLEIKRTVAAPEIVLTQSPDFQSVTPKEKVTITCRASQDIGSELHWYQQKPDQPPKLLIKYASHSTSGVPSRFSGSGSGTDFTLTINGLEAEDAGTYYCHQTDSLPYTFGPGTKVDIKR

SEQ ID NO: 80 - protein, 254 aa, Artificial Sequence
  Description of Artificial Sequence: Synthetic polypeptide
EVQLVQSGAEVKKPGSSVKVSCKASGGSFGGYGIGWVRQAPGQGLEWMGGITPFFGFADYAQKFQGRVTITADESTTTAYMELSGLTSDDTAVYYCARDPNEFWNGYYSTHDFDSWGQGTTVTVSSASTKGPEVQLQESGPGLVKPSETLSLTCTVSGFSLSDYGVSWIRQPPGKGLEWLGLIWGGGDTYYNSPLKSRLTISKDNSKSQVSLKLSSVTAADTAVYYCAKQRTLWGYDLYGMDYWGQGTLVTVSS

SEQ ID NO: 81 - protein, 221 aa, Artificial Sequence
  Description of Artificial Sequence: Synthetic polypeptide
EIVLTQSPDFQSVTPKEKVTITCRASQDIGSELHWYQQKPDQPPKLLIKYASHSTSGVPSRFSGSGSGTDFTLTINGLEAEDAGTYYCHQTDSLPYTFGPGTKVDIKRTVAAPDTQVTQSPSSLSASVGDRVTITCITSTDIDVDMNWYQQKPGKPPKLLISQGNTLRPGVPSRFSSSGSGTDFTFTISSLQPEDFATYYCLQSDNLPLTFGQGTKLEIKR

SEQ ID NO: 82 - protein, 254 aa, Artificial Sequence; identical to SEQ ID NO: 78
  Description of Artificial Sequence: Synthetic polypeptide

SEQ ID NO: 83 - protein, 221 aa, Artificial Sequence
  Description of Artificial Sequence: Synthetic polypeptide
DTVVTQSPAFLSVTPGEKVTITCITSTDIDVDMNWYQQKPDQPPKLLISQGNTLRPGVPSRFSSSGSGTDFTFTISSLEAEDAATYYCLQSDNLPLTFGQGTKLEIKRTVAAPEIVLTQSPDFQSVTPKEKVTITCRASQDIGSELHWYQQKPDQPPKLLIKYASHSTSGVPSRFSGSGSGTDFTLTINGLEAEDAGTYYCHQTDSLPYTFGPGTKVDIKR

SEQ ID NO: 84 - protein, 254 aa, Artificial Sequence; identical to SEQ ID NO: 80
  Description of Artificial Sequence: Synthetic polypeptide

SEQ ID NO: 85 - protein, 221 aa, Artificial Sequence
  Description of Artificial Sequence: Synthetic polypeptide
EIVLTQSPDFQSVTPKEKVTITCRASQDIGSELHWYQQKPDQPPKLLIKYASHSTSGVPSRFSGSGSGTDFTLTINGLEAEDAGTYYCHQTDSLPYTFGPGTKVDIKRTVAAPDTVVTQSPAFLSVTPGEKVTITCITSTDIDVDMNWYQQKPDQPPKLLISQGNTLRPGVPSRFSSSGSGTDFTFTISSLEAEDAATYYCLQSDNLPLTFGQGTKLEIKR

SEQ ID NO: 86 - protein, 254 aa, Artificial Sequence
  Description of Artificial Sequence: Synthetic polypeptide
EVQLVESGGGLVQPGGSLRLSCAVSGFTLSDYGVSWIRQAPGKGLEWLGLIWGGGDTYYNSPLKSRLTISKDNSKSTVYLQMNSLRAEDTAVYYCAKQRTLWGYDLYGMDYWGQGTLVTVSSASTKGPEVQLVQSGAEVKKPGSSVKVSCKASGGSFGGYGIGWVRQAPGQGLEWMGGITPFFGFADYAQKFQGRVTITADESTTTAYMELSGLTSDDTAVYYCARDPNEFWNGYYSTHDFDSWGQGTTVTVSS

SEQ ID NO: 87 - protein, 221 aa, Artificial Sequence
  Description of Artificial Sequence: Synthetic polypeptide
ETTVTQSPSSLSASVGDRVTITCITSTDIDVDMNWYQQKPGKPPKLLISQGNTLRPGVPSRFSSSGSGTDFTFTISSLQPEDFATYYCLQSDNLPLTFGQGTKLEIKRTVAAPEIVLTQSPDFQSVTPKEKVTITCRASQDIGSELHWYQQKPDQPPKLLIKYASHSTSGVPSRFSGSGSGTDFTLTINGLEAEDAGTYYCHQTDSLPYTFGPGTKVDIKR

SEQ ID NO: 88 - protein, 254 aa, Artificial Sequence
  Description of Artificial Sequence: Synthetic polypeptide
EVQLVQSGAEVKKPGSSVKVSCKASGGSFGGYGIGWVRQAPGQGLEWMGGITPFFGFADYAQKFQGRVTITADESTTTAYMELSGLTSDDTAVYYCARDPNEFWNGYYSTHDFDSWGQGTTVTVSSASTKGPEVQLVESGGGLVQPGGSLRLSCAVSGFTLSDYGVSWIRQAPGKGLEWLGLIWGGGDTYYNSPLKSRLTISKDNSKSTVYLQMNSLRAEDTAVYYCAKQRTLWGYDLYGMDYWGQGTLVTVSS

SEQ ID NO: 89 - protein, 221 aa, Artificial Sequence
  Description of Artificial Sequence: Synthetic polypeptide
EIVLTQSPDFQSVTPKEKVTITCRASQDIGSELHWYQQKPDQPPKLLIKYASHSTSGVPSRFSGSGSGTDFTLTINGLEAEDAGTYYCHQTDSLPYTFGPGTKVDIKRTVAAPETTVTQSPSSLSASVGDRVTITCITSTDIDVDMNWYQQKPGKPPKLLISQGNTLRPGVPSRFSSSGSGTDFTFTISSLQPEDFATYYCLQSDNLPLTFGQGTKLEIKR

SEQ ID NO: 90 - protein, 251 aa, Artificial Sequence
  Description of Artificial Sequence: Synthetic polypeptide
EVQLVESGGGVVQPGRSLRLSCSASGFIFSRYDMSWVRQAPGKGLEWVAYISHGGAGTYYPDSVKGRFTISRDNSKNTLFLQMDSLRPEDTGVYFCARGGVTKGYFDVWGQGTPVTVSSASTKGPEVQLVQSGAEVKKPGESVKISCKASGGSFRSYGISWVRQAPGQGLEWMGGITHFFGITDYAQKFQGRVTITADESTTTAYMELSGLTSDDTAVYYCAREPNDFWNGYYDTHDFDSWGQGTTVTVSS

SEQ ID NO: 91 - protein, 221 aa, Artificial Sequence
  Description of Artificial Sequence: Synthetic polypeptide
DIQMTQSPSSLSASVGDRVTITCRASGNIHNYLTWYQQTPGKAPKLLIYNAKTLADGVPSRFSGSGSGTDYTFTISSLQPEDIATYYCQHFWSIPYTFGQGTKLQITRTVAAPEIVLTQSPDFQSVTPKEKVTITCRASQNIGSELHWYQQKPDQSPKLLIKYASHSISGVPSRFSGSGSGTDFTLTINGLEAEDAATYYCHQSDTLPHTFGQGTKVDIKR

SEQ ID NO: 92 - protein, 251 aa, Artificial Sequence
  Description of Artificial Sequence: Synthetic polypeptide
EVQLVQSGAEVKKPGESVKISCKASGGSFRSYGISWVRQAPGQGLEWMGGITHFFGITDYAQKFQGRVTITADESTTTAYMELSGLTSDDTAVYYCAREPNDFWNGYYDTHDFDSWGQGTTVTVSSASTKGPEVQLVESGGGVVQPGRSLRLSCSASGFIFSRYDMSWVRQAPGKGLEWVAYISHGGAGTYYPDSVKGRFTISRDNSKNTLFLQMDSLRPEDTGVYFCARGGVTKGYFDVWGQGTPVTVSS

SEQ ID NO: 93 - protein, 221 aa, Artificial Sequence
  Description of Artificial Sequence: Synthetic polypeptide
EIVLTQSPDFQSVTPKEKVTITCRASQNIGSELHWYQQKPDQSPKLLIKYASHSISGVPSRFSGSGSGTDFTLTINGLEAEDAATYYCHQSDTLPHTFGQGTKVDIKRTVAAPDIQMTQSPSSLSASVGDRVTITCRASGNIHNYLTWYQQTPGKAPKLLIYNAKTLADGVPSRFSGSGSGTDYTFTISSLQPEDIATYYCQHFWSIPYTFGQGTKLQITR

SEQ ID NO: 94 - protein, 251 aa, Artificial Sequence
  Description of Artificial Sequence: Synthetic polypeptide
EVQLVESGGGVVQPGRSLRLSCSASGFIFSRYDMSWVRQAPGKGLEWVAYISHGGAGTYYPDSVKGRFTISRDNSKNTLFLQMDSLRAEDTAVYYCARGGVYKGYFDVWGQGTPVTVSSASTKGPEVQLVQSGAEVKKPGESVKISCKASGGSFRSYGISWVRQAPGQGLEWMGGITHFFGITDYAQKFQGRVTITADESTTTAYMELSGLTSDDTAVYYCAREPNDFWNGYYDTHDFDSWGQGTTVTVSS

SEQ ID NO: 95 - protein, 221 aa, Artificial Sequence; identical to SEQ ID NO: 91
  Description of Artificial Sequence: Synthetic polypeptide

SEQ ID NO: 96 - protein, 251 aa, Artificial Sequence
  Description of Artificial Sequence: Synthetic polypeptide
EVQLVQSGAEVKKPGESVKISCKASGGSFRSYGISWVRQAPGQGLEWMGGITHFFGITDYAQKFQGRVTITADESTTTAYMELSGLTSDDTAVYYCAREPNDFWNGYYDTHDFDSWGQGTTVTVSSASTKGPEVQLVESGGGVVQPGRSLRLSCSASGFIFSRYDMSWVRQAPGKGLEWVAYISHGGAGTYYPDSVKGRFTISRDNSKNTLFLQMDSLRAEDTAVYYCARGGVYKGYFDVWGQGTPVTVSS

SEQ ID NO: 97 - protein, 221 aa, Artificial Sequence; identical to SEQ ID NO: 93
  Description of Artificial Sequence: Synthetic polypeptide

SEQ ID NO: 98 - protein, 254 aa, Artificial Sequence
  Description of Artificial Sequence: Synthetic polypeptide
EVQLQESGPGLVKPSETLSLTCTVSGFSLSDYGVSWIRQPPGKGLEWLGLIWGGGDTYYNSPLKSRLTISKDNSKSQVSLKLSSVTAADTAVYYCAKQRTLWGYDLYGMDYWGQGTLVTVSSASTKGPEVQLVQSGAEVKKPGESVKISCKASGGSFRSYGISWVRQAPGQGLEWMGGITHFFGITDYAQKFQGRVTITADESTTTAYMELSGLTSDDTAVYYCAREPNDFWNGYYDTHDFDSWGQGTTVTVSS

SEQ ID NO: 99 - protein, 221 aa, Artificial Sequence
  Description of Artificial Sequence: Synthetic polypeptide
DTQVTQSPSSLSASVGDRVTITCITSTDIDVDMNWYQQKPGKPPKLLISQGNTLRPGVPSRFSSSGSGTDFTFTISSLQPEDFATYYCLQSDNLPLTFGQGTKLEIKRTVAAPEIVLTQSPDFQSVTPKEKVTITCRASQNIGSELHWYQQKPDQSPKLLIKYASHSISGVPSRFSGSGSGTDFTLTINGLEAEDAATYYCHQSDTLPHTFGQGTKVDIKR

SEQ ID NO: 100 - protein, 254 aa, Artificial Sequence
  Description of Artificial Sequence: Synthetic polypeptide
EVQLVQSGAEVKKPGESVKISCKASGGSFRSYGISWVRQAPGQGLEWMGGITHFFGITDYAQKFQGRVTITADESTTTAYMELSGLTSDDTAVYYCAREPNDFWNGYYDTHDFDSWGQGTTVTVSSASTKGPEVQLQESGPGLVKPSETLSLTCTVSGFSLSDYGVSWIRQPPGKGLEWLGLIWGGGDTYYNSPLKSRLTISKDNSKSQVSLKLSSVTAADTAVYYCAKQRTLWGYDLYGMDYWGQGTLVTVSS

SEQ ID NO: 101 - protein, 221 aa, Artificial Sequence
  Description of Artificial Sequence: Synthetic polypeptide
EIVLTQSPDFQSVTPKEKVTITCRASQNIGSELHWYQQKPDQSPKLLIKYASHSISGVPSRFSGSGSGTDFTLTINGLEAEDAATYYCHQSDTLPHTFGQGTKVDIKRTVAAPDTQVTQSPSSLSASVGDRVTITCITSTDIDVDMNWYQQKPGKPPKLLISQGNTLRPGVPSRFSSSGSGTDFTFTISSLQPEDFATYYCLQSDNLPLTFGQGTKLEIKR

SEQ ID NO: 102 - protein, 254 aa, Artificial Sequence; identical to SEQ ID NO: 98
  Description of Artificial Sequence: Synthetic polypeptide

SEQ ID NO: 103 - protein, 221 aa, Artificial Sequence
  Description of Artificial Sequence: Synthetic polypeptide
DTVVTQSPAFLSVTPGEKVTITCITSTDIDVDMNWYQQKPDQPPKLLISQGNTLRPGVPSRFSSSGSGTDFTFTISSLEAEDAATYYCLQSDNLPLTFGQGTKLEIKRTVAAPEIVLTQSPDFQSVTPKEKVTITCRASQNIGSELHWYQQKPDQSPKLLIKYASHSISGVPSRFSGSGSGTDFTLTINGLEAEDAATYYCHQSDTLPHTFGQGTKVDIKR

SEQ ID NO: 104 - protein, 254 aa, Artificial Sequence; identical to SEQ ID NO: 100
  Description of Artificial Sequence: Synthetic polypeptide

SEQ ID NO: 105 - protein, 221 aa, Artificial Sequence
  Description of Artificial Sequence: Synthetic polypeptide
EIVLTQSPDFQSVTPKEKVTITCRASQNIGSELHWYQQKPDQSPKLLIKYASHSISGVPSRFSGSGSGTDFTLTINGLEAEDAATYYCHQSDTLPHTFGQGTKVDIKRTVAAPDTVVTQSPAFLSVTPGEKVTITCITSTDIDVDMNWYQQKPDQPPKLLISQGNTLRPGVPSRFSSSGSGTDFTFTISSLEAEDAATYYCLQSDNLPLTFGQGTKLEIKR

SEQ ID NO: 106 - protein, 254 aa, Artificial Sequence
  Description of Artificial Sequence: Synthetic polypeptide
EVQLVESGGGLVQPGGSLRLSCAVSGFTLSDYGVSWIRQAPGKGLEWLGLIWGGGDTYYNSPLKSRLTISKDNSKSTVYLQMNSLRAEDTAVYYCAKQRTLWGYDLYGMDYWGQGTLVTVSSASTKGPEVQLVQSGAEVKKPGESVKISCKASGGSFRSYGISWVRQAPGQGLEWMGGITHFFGITDYAQKFQGRVTITADESTTTAYMELSGLTSDDTAVYYCAREPNDFWNGYYDTHDFDSWGQGTTVTVSS

SEQ ID NO: 107 - protein, 221 aa, Artificial Sequence
  Description of Artificial Sequence: Synthetic polypeptide
ETTVTQSPSSLSASVGDRVTITCITSTDIDVDMNWYQQKPGKPPKLLISQGNTLRPGVPSRFSSSGSGTDFTFTISSLQPEDFATYYCLQSDNLPLTFGQGTKLEIKRTVAAPEIVLTQSPDFQSVTPKEKVTITCRASQNIGSELHWYQQKPDQSPKLLIKYASHSISGVPSRFSGSGSGTDFTLTINGLEAEDAATYYCHQSDTLPHTFGQGTKVDIKR

SEQ ID NO: 108 - protein, 254 aa, Artificial Sequence
  Description of Artificial Sequence: Synthetic polypeptide
EVQLVQSGAEVKKPGESVKISCKASGGSFRSYGISWVRQAPGQGLEWMGGITHFFGITDYAQKFQGRVTITADESTTTAYMELSGLTSDDTAVYYCAREPNDFWNGYYDTHDFDSWGQGTTVTVSSASTKGPEVQLVESGGGLVQPGGSLRLSCAVSGFTLSDYGVSWIRQAPGKGLEWLGLIWGGGDTYYNSPLKSRLTISKDNSKSTVYLQMNSLRAEDTAVYYCAKQRTLWGYDLYGMDYWGQGTLVTVSS

SEQ ID NO: 109 - protein, 221 aa, Artificial Sequence
  Description of Artificial Sequence: Synthetic polypeptide
EIVLTQSPDFQSVTPKEKVTITCRASQNIGSELHWYQQKPDQSPKLLIKYASHSISGVPSRFSGSGSGTDFTLTINGLEAEDAATYYCHQSDTLPHTFGQGTKVDIKRTVAAPETTVTQSPSSLSASVGDRVTITCITSTDIDVDMNWYQQKPGKPPKLLISQGNTLRPGVPSRFSSSGSGTDFTFTISSLQPEDFATYYCLQSDNLPLTFGQGTKLEIKR

SEQ ID NO: 110 - protein, 246 aa, Artificial Sequence; identical to SEQ ID NO: 50
  Description of Artificial Sequence: Synthetic polypeptide

SEQ ID NO: 111 - protein, 228 aa, Artificial Sequence
  Description of Artificial Sequence: Synthetic polypeptide
DIQMTQSPSSLSASVGDRVTITCRASGNIHNYLTWYQQTPGKAPKLLIYNAKTLADGVPSRFSGSGSGTDYTFTISSLQPEDIATYYCQHFWSIPYTFGQGTKLQITRTVAAPSVFIFPPDIQMTQSPSSLSASVGDRVTITCRASSGIISYIDWFQQKPGKAPKRLIYATFDLASGVPSRFSGSGSGTDYTLTISSLQPEDFATYYCRQVGSYPETFGQGTKLEIKR

SEQ ID NO: 112 - protein, 246 aa, Artificial Sequence; identical to SEQ ID NO: 52
  Description of Artificial Sequence: Synthetic polypeptide

SEQ ID NO: 113 - protein, 228 aa, Artificial Sequence
  Description of Artificial Sequence: Synthetic polypeptide
DIQMTQSPSSLSASVGDRVTITCRASSGIISYIDWFQQKPGKAPKRLIYATFDLASGVPSRFSGSGSGTDYTLTISSLQPEDFATYYCRQVGSYPETFGQGTKLEIKRTVAAPSVFIFPPDIQMTQSPSSLSASVGDRVTITCRASGNIHNYLTWYQQTPGKAPKLLIYNAKTLADGVPSRFSGSGSGTDYTFTISSLQPEDIATYYCQHFWSIPYTFGQGTKLQITR

SEQ ID NO: 114 - protein, 246 aa, Artificial Sequence; identical to SEQ ID NO: 54
  Description of Artificial Sequence: Synthetic polypeptide

SEQ ID NO: 115 - protein, 228 aa, Artificial Sequence; identical to SEQ ID NO: 111
  Description of Artificial Sequence: Synthetic polypeptide

SEQ ID NO: 116 - protein, 246 aa, Artificial Sequence; identical to SEQ ID NO: 56
  Description of Artificial Sequence: Synthetic polypeptide

SEQ ID NO: 117 - protein, 228 aa, Artificial Sequence; identical to SEQ ID NO: 113
  Description of Artificial Sequence: Synthetic polypeptide

SEQ ID NO: 118 - protein, 249 aa, Artificial Sequence; identical to SEQ ID NO: 58
  Description of Artificial Sequence: Synthetic polypeptide

SEQ ID NO: 119 - protein, 228 aa, Artificial Sequence
  Description of Artificial Sequence: Synthetic polypeptide
DTQVTQSPSSLSASVGDRVTITCITSTDIDVDMNWYQQKPGKPPKLLISQGNTLRPGVPSRFSSSGSGTDFTFTISSLQPEDFATYYCLQSDNLPLTFGQGTKLEIKRTVAAPSVFIFPPDIQMTQSPSSLSASVGDRVTITCRASSGIISYIDWFQQKPGKAPKRLIYATFDLASGVPSRFSGSGSGTDYTLTISSLQPEDFATYYCRQVGSYPETFGQGTKLEIKR

SEQ ID NO: 120 - protein, 249 aa, Artificial Sequence; identical to SEQ ID NO: 60
  Description of Artificial Sequence: Synthetic polypeptide

SEQ ID NO: 121 - protein, 228 aa, Artificial Sequence
  Description of Artificial Sequence: Synthetic polypeptide
DIQMTQSPSSLSASVGDRVTITCRASSGIISYIDWFQQKPGKAPKRLIYATFDLASGVPSRFSGSGSGTDYTLTISSLQPEDFATYYCRQVGSYPETFGQGTKLEIKRTVAAPSVFIFPPDTQVTQSPSSLSASVGDRVTITCITSTDIDVDMNWYQQKPGKPPKLLISQGNTLRPGVPSRFSSSGSGTDFTFTISSLQPEDFATYYCLQSDNLPLTFGQGTKLEIKR

SEQ ID NO: 122 - protein, 249 aa, Artificial Sequence; identical to SEQ ID NO: 58
  Description of Artificial Sequence: Synthetic polypeptide

SEQ ID NO: 123 - protein, 228 aa, Artificial Sequence
  Description of Artificial Sequence: Synthetic polypeptide
DTVVTQSPAFLSVTPGEKVTITCITSTDIDVDMNWYQQKPDQPPKLLISQGNTLRPGVPSRFSSSGSGTDFTFTISSLEAEDAATYYCLQSDNLPLTFGQGTKLEIKRTVAAPSVFIFPPDIQMTQSPSSLSASVGDRVTITCRASSGIISYIDWFQQKPGKAPKRLIYATFDLASGVPSRFSGSGSGTDYTLTISSLQPEDFATYYCRQVGSYPETFGQGTKLEIKR

SEQ ID NO: 124 - protein, 249 aa, Artificial Sequence; identical to SEQ ID NO: 60
  Description of Artificial Sequence: Synthetic polypeptide

SEQ ID NO: 125 - protein, 228 aa, Artificial Sequence
  Description of Artificial Sequence: Synthetic polypeptide
DIQMTQSPSSLSASVGDRVTITCRASSGIISYIDWFQQKPGKAPKRLIYATFDLASGVPSRFSGSGSGTDYTLTISSLQPEDFATYYCRQVGSYPETFGQGTKLEIKRTVAAPSVFIFPPDTVVTQSPAFLSVTPGEKVTITCITSTDIDVDMNWYQQKPDQPPKLLISQGNTLRPGVPSRFSSSGSGTDFTFTISSLEAEDAATYYCLQSDNLPLTFGQGTKLEIKR

SEQ ID NO: 126 - protein, 249 aa, Artificial Sequence; identical to SEQ ID NO: 66
  Description of Artificial Sequence: Synthetic polypeptide

SEQ ID NO: 127 - protein, 228 aa, Artificial Sequence
  Description of Artificial Sequence: Synthetic polypeptide
ETTVTQSPSSLSASVGDRVTITCITSTDIDVDMNWYQQKPGKPPKLLISQGNTLRPGVPSRFSSSGSGTDFTFTISSLQPEDFATYYCLQSDNLPLTFGQGTKLEIKRTVAAPSVFIFPPDIQMTQSPSSLSASVGDRVTITCRASSGIISYIDWFQQKPGKAPKRLIYATFDLASGVPSRFSGSGSGTDYTLTISSLQPEDFATYYCRQVGSYPETFGQGTKLEIKR

SEQ ID NO: 128 - protein, 249 aa, Artificial Sequence; identical to SEQ ID NO: 68
  Description of Artificial Sequence: Synthetic polypeptide

SEQ ID NO: 129 - protein, 228 aa, Artificial Sequence
  Description of Artificial Sequence: Synthetic polypeptide
DIQMTQSPSSLSASVGDRVTITCRASSGIISYIDWFQQKPGKAPKRLIYATFDLASGVPSRFSGSGSGTDYTLTISSLQPEDFATYYCRQVGSYPETFGQGTKLEIKRTVAAPSVFIFPPETTVTQSPSSLSASVGDRVTITCITSTDIDVDMNWYQQKPGKPPKLLISQGNTLRPGVPSRFSSSGSGTDFTFTISSLQPEDFATYYCLQSDNLPLTFGQGTKLEIKR

SEQ ID NO: 130 - protein, 251 aa, Artificial Sequence; identical to SEQ ID NO: 70
  Description of Artificial Sequence: Synthetic polypeptide

SEQ ID NO: 131 - protein, 228 aa, Artificial Sequence
  Description of Artificial Sequence: Synthetic polypeptide
DIQMTQSPSSLSASVGDRVTITCRASGNIHNYLTWYQQTPGKAPKLLIYNAKTLADGVPSRFSGSGSGTDYTFTISSLQPEDIATYYCQHFWSIPYTFGQGTKLQITRTVAAPSVFIFPPEIVLTQSPDFQSVTPKEKVTITCRASQDIGSELHWYQQKPDQPPKLLIKYASHSTSGVPSRFSGSGSGTDFTLTINGLEAEDAGTYYCHQTDSLPYTFGPGTKVDIKR

SEQ ID NO: 132 - protein, 251 aa, Artificial Sequence; identical to SEQ ID NO: 72
  Description of Artificial Sequence: Synthetic polypeptide

SEQ ID NO: 133 - protein, 228 aa, Artificial Sequence
  Description of Artificial Sequence: Synthetic polypeptide
EIVLTQSPDFQSVTPKEKVTITCRASQDIGSELHWYQQKPDQPPKLLIKYASHSTSGVPSRFSGSGSGTDFTLTINGLEAEDAGTYYCHQTDSLPYTFGPGTKVDIKRTVAAPSVFIFPPDIQMTQSPSSLSASVGDRVTITCRASGNIHNYLTWYQQTPGKAPKLLIYNAKTLADGVPSRFSGSGSGTDYTFTISSLQPEDIATYYCQHFWSIPYTFGQGTKLQITR

SEQ ID NO: 134 - protein, 251 aa, Artificial Sequence; identical to SEQ ID NO: 74
  Description of Artificial Sequence: Synthetic polypeptide

SEQ ID NO: 135 - protein, 228 aa, Artificial Sequence; identical to SEQ ID NO: 131
  Description of Artificial Sequence: Synthetic polypeptide

SEQ ID NO: 136 - protein, 251 aa, Artificial Sequence; identical to SEQ ID NO: 76
  Description of Artificial Sequence: Synthetic polypeptide

SEQ ID NO: 137 - protein, 228 aa, Artificial Sequence; identical to SEQ ID NO: 133
  Description of Artificial Sequence: Synthetic polypeptide

SEQ ID NO: 138 - protein, 254 aa, Artificial Sequence; identical to SEQ ID NO: 78
  Description of Artificial Sequence: Synthetic polypeptide

SEQ ID NO: 139 - protein, 228 aa, Artificial Sequence
  Description of Artificial Sequence: Synthetic polypeptide
DTQVTQSPSSLSASVGDRVTITCITSTDIDVDMNWYQQKPGKPPKLLISQGNTLRPGVPSRFSSSGSGTDFTFTISSLQPEDFATYYCLQSDNLPLTFGQGTKLEIKRTVAAPSVFIFPPEIVLTQSPDFQSVTPKEKVTITCRASQDIGSELHWYQQKPDQPPKLLIKYASHSTSGVPSRFSGSGSGTDFTLTINGLEAEDAGTYYCHQTDSLPYTFGPGTKVDIKR

SEQ ID NO: 140 - protein, 254 aa, Artificial Sequence; identical to SEQ ID NO: 80
  Description of Artificial Sequence: Synthetic polypeptide

SEQ ID NO: 141 - protein, 228 aa, Artificial Sequence
  Description of Artificial Sequence: Synthetic polypeptide
EIVLTQSPDFQSVTPKEKVTITCRASQDIGSELHWYQQKPDQPPKLLIKYASHSTSGVPSRFSGSGSGTDFTLTINGLEAEDAGTYYCHQTDSLPYTFGPGTKVDIKRTVAAPSVFIFPPDTQVTQSPSSLSASVGDRVTITCITSTDIDVDMNWYQQKPGKPPKLLISQGNTLRPGVPSRFSSSGSGTDFTFTISSLQPEDFATYYCLQSDNLPLTFGQGTKLEIKR

SEQ ID NO: 142 - protein, 254 aa, Artificial Sequence; identical to SEQ ID NO: 78
  Description of Artificial Sequence: Synthetic polypeptide

SEQ ID NO: 143 - protein, 228 aa, Artificial Sequence
  Description of Artificial Sequence: Synthetic polypeptide
DTVVTQSPAFLSVTPGEKVTITCITSTDIDVDMNWYQQKPDQPPKLLISQGNTLRPGVPSRFSSSGSGTDFTFTISSLEAEDAATYYCLQSDNLPLTFGQGTKLEIKRTVAAPSVFIFPPEIVLTQSPDFQSVTPKEKVTITCRASQDIGSELHWYQQKPDQPPKLLIKYASHSTSGVPSRFSGSGSGTDFTLTINGLEAEDAGTYYCHQTDSLPYTFGPGTKVDIKR

SEQ ID NO: 144 - protein, 254 aa, Artificial Sequence; identical to SEQ ID NO: 80
  Description of Artificial Sequence: Synthetic polypeptide

SEQ ID NO: 145 - protein, 228 aa, Artificial Sequence
  Description of Artificial Sequence: Synthetic polypeptide
EIVLTQSPDFQSVTPKEKVTITCRASQDIGSELHWYQQKPDQPPKLLIKYASHSTSGVPSRFSGSGSGTDFTLTINGLEAEDAGTYYCHQTDSLPYTFGPGTKVDIKRTVAAPSVFIFPPDTVVTQSPAFLSVTPGEKVTITCITSTDIDVDMNWYQQKPDQPPKLLISQGNTLRPGVPSRFSSSGSGTDFTFTISSLEAEDAATYYCLQSDNLPLTFGQGTKLEIKR

SEQ ID NO: 146 - protein, 254 aa, Artificial Sequence; identical to SEQ ID NO: 86
  Description of Artificial Sequence: Synthetic polypeptide

SEQ ID NO: 147 - protein, 228 aa, Artificial Sequence
  Description of Artificial Sequence: Synthetic polypeptide
ETTVTQSPSSLSASVGDRVTITCITSTDIDVDMNWYQQKPGKPPKLLISQGNTLRPGVPSRFSSSGSGTDFTFTISSLQPEDFATYYCLQSDNLPLTFGQGTKLEIKRTVAAPSVFIFPPEIVLTQSPDFQSVTPKEKVTITCRASQDIGSELHWYQQKPDQPPKLLIKYASHSTSGVPSRFSGSGSGTDFTLTINGLEAEDAGTYYCHQTDSLPYTFGPGTKVDIKR

SEQ ID NO: 148 - protein, 254 aa, Artificial Sequence; identical to SEQ ID NO: 88
  Description of Artificial Sequence: Synthetic polypeptide

SEQ ID NO: 149 - protein, 228 aa, Artificial Sequence
  Description of Artificial Sequence: Synthetic polypeptide
EIVLTQSPDFQSVTPKEKVTITCRASQDIGSELHWYQQKPDQPPKLLIKYASHSTSGVPSRFSGSGSGTDFTLTINGLEAEDAGTYYCHQTDSLPYTFGPGTKVDIKRTVAAPSVFIFPPETTVTQSPSSLSASVGDRVTITCITSTDIDVDMNWYQQKPGKPPKLLISQGNTLRPGVPSRFSSSGSGTDFTFTISSLQPEDFATYYCLQSDNLPLTFGQGTKLEIKR

SEQ ID NO: 150 - protein, 251 aa, Artificial Sequence; identical to SEQ ID NO: 90
  Description of Artificial Sequence: Synthetic polypeptide

SEQ ID NO: 151 - protein, 228 aa, Artificial Sequence
  Description of Artificial Sequence: Synthetic polypeptide
DIQMTQSPSSLSASVGDRVTITCRASGNIHNYLTWYQQTPGKAPKLLIYNAKTLADGVPSRFSGSGSGTDYTFTISSLQPEDIATYYCQHFWSIPYTFGQGTKLQITRTVAAPSVFIFPPEIVLTQSPDFQSVTPKEKVTITCRASQNIGSELHWYQQKPDQSPKLLIKYASHSISGVPSRFSGSGSGTDFTLTINGLEAEDAATYYCHQSDTLPHTFGQGTKVDIKR

SEQ ID NO: 152 - protein, 251 aa, Artificial Sequence; identical to SEQ ID NO: 92
  Description of Artificial Sequence: Synthetic polypeptide

SEQ ID NO: 153 - protein, 228 aa, Artificial Sequence
  Description of Artificial Sequence: Synthetic polypeptide
EIVLTQSPDFQSVTPKEKVTITCRASQNIGSELHWYQQKPDQSPKLLIKYASHSISGVPSRFSGSGSGTDFTLTINGLEAEDAATYYCHQSDTLPHTFGQGTKVDIKRTVAAPSVFIFPPDIQMTQSPSSLSASVGDRVTITCRASGNIHNYLTWYQQTPGKAPKLLIYNAKTLADGVPSRFSGSGSGTDYTFTISSLQPEDIATYYCQHFWSIPYTFGQGTKLQITR

SEQ ID NO: 154 - protein, 251 aa, Artificial Sequence; identical to SEQ ID NO: 94
  Description of Artificial Sequence: Synthetic polypeptide

SEQ ID NO: 155 - protein, 228 aa, Artificial Sequence; identical to SEQ ID NO: 151
  Description of Artificial Sequence: Synthetic polypeptide

SEQ ID NO: 156 - protein, 251 aa, Artificial Sequence; identical to SEQ ID NO: 96
  Description of Artificial Sequence: Synthetic polypeptide

SEQ ID NO: 157 - protein, 228 aa, Artificial Sequence; identical to SEQ ID NO: 153
  Description of Artificial Sequence: Synthetic polypeptide

SEQ ID NO: 158 - protein, 254 aa, Artificial Sequence; identical to SEQ ID NO: 98
  Description of Artificial Sequence: Synthetic polypeptide

SEQ ID NO: 159 - protein, 228 aa, Artificial Sequence
  Description of Artificial Sequence: Synthetic polypeptide
DTQVTQSPSSLSASVGDRVTITCITSTDIDVDMNWYQQKPGKPPKLLISQGNTLRPGVPSRFSSSGSGTDFTFTISSLQPEDFATYYCLQSDNLPLTFGQGTKLEIKRTVAAPSVFIFPPEIVLTQSPDFQSVTPKEKVTITCRASQNIGSELHWYQQKPDQSPKLLIKYASHSISGVPSRFSGSGSGTDFTLTINGLEAEDAATYYCHQSDTLPHTFGQGTKVDIKR

SEQ ID NO: 160 - protein, 254 aa, Artificial Sequence; identical to SEQ ID NO: 100
  Description of Artificial Sequence: Synthetic polypeptide

SEQ ID NO: 161 - protein, 228 aa, Artificial Sequence
  Description of Artificial Sequence: Synthetic polypeptide
EIVLTQSPDFQSVTPKEKVTITCRASQNIGSELHWYQQKPDQSPKLLIKYASHSISGVPSRFSGSGSGTDFTLTINGLEAEDAATYYCHQSDTLPHTFGQGTKVDIKRTVAAPSVFIFPPDTQVTQSPSSLSASVGDRVTITCITSTDIDVDMNWYQQKPGKPPKLLISQGNTLRPGVPSRFSSSGSGTDFTFTISSLQPEDFATYYCLQSDNLPLTFGQGTKLEIKR

SEQ ID NO: 162 - protein, 254 aa, Artificial Sequence; identical to SEQ ID NO: 98
  Description of Artificial Sequence: Synthetic polypeptide

SEQ ID NO: 163 - protein, 228 aa, Artificial Sequence
  Description of Artificial Sequence: Synthetic polypeptide
DTVVTQSPAFLSVTPGEKVTITCITSTDIDVDMNWYQQKPDQPPKLLISQGNTLRPGVPSRFSSSGSGTDFTFTISSLEAEDAATYYCLQSDNLPLTFGQGTKLEIKRTVAAPSVFIFPPEIVLTQSPDFQSVTPKEKVTITCRASQNIGSELHWYQQKPDQSPKLLIKYASHSISGVPSRFSGSGSGTDFTLTINGLEAEDAATYYCHQSDTLPHTFGQGTKVDIKR

SEQ ID NO: 164 - protein, 254 aa, Artificial Sequence; identical to SEQ ID NO: 100
  Description of Artificial Sequence: Synthetic polypeptide

SEQ ID NO: 165 - protein, 228 aa, Artificial Sequence
  Description of Artificial Sequence: Synthetic polypeptide
EIVLTQSPDFQSVTPKEKVTITCRASQNIGSELHWYQQKPDQSPKLLIKYASHSISGVPSRFSGSGSGTDFTLTINGLEAEDAATYYCHQSDTLPHTFGQGTKVDIKRTVAAPSVFIFPPDTVVTQSPAFLSVTPGEKVTITCITSTDIDVDMNWYQQKPDQPPKLLISQGNTLRPGVPSRFSSSGSGTDFTFTISSLEAEDAATYYCLQSDNLPLTFGQGTKLEIKR

SEQ ID NO: 166 - protein, 254 aa, Artificial Sequence; identical to SEQ ID NO: 106
  Description of Artificial Sequence: Synthetic polypeptide

SEQ ID NO: 167 - protein, 228 aa, Artificial Sequence
  Description of Artificial Sequence: Synthetic polypeptide
ETTVTQSPSSLSASVGDRVTITCITSTDIDVDMNWYQQKPGKPPKLLISQGNTLRPGVPSRFSSSGSGTDFTFTISSLQPEDFATYYCLQSDNLPLTFGQGTKLEIKRTVAAPSVFIFPPEIVLTQSPDFQSVTPKEKVTITCRASQNIGSELHWYQQKPDQSPKLLIKYASHSISGVPSRFSGSGSGTDFTLTINGLEAEDAATYYCHQSDTLPHTFGQGTKVDIKR

SEQ ID NO: 168 - protein, 254 aa, Artificial Sequence; identical to SEQ ID NO: 108
  Description of Artificial Sequence: Synthetic polypeptide

SEQ ID NO: 169 - protein, 228 aa, Artificial Sequence
  Description of Artificial Sequence: Synthetic polypeptide
EIVLTQSPDFQSVTPKEKVTITCRASQNIGSELHWYQQKPDQSPKLLIKYASHSISGVPSRFSGSGSGTDFTLTINGLEAEDAATYYCHQSDTLPHTFGQGTKVDIKRTVAAPSVFIFPPETTVTQSPSSLSASVGDRVTITCITSTDIDVDMNWYQQKPGKPPKLLISQGNTLRPGVPSRFSSSGSGTDFTFTISSLQPEDFATYYCLQSDNLPLTFGQGTKLEIKR

SEQ ID NO: 170 - protein, 253 aa, Artificial Sequence
  Description of Artificial Sequence: Synthetic polypeptide
EVQLVESGGGVVQPGRSLRLSCSASGFIFSRYDMSWVRQAPGKGLEWVAYISHGGAGTYYPDSVKGRFTISRDNSKNTLFLQMDSLRPEDTGVYFCARGGVTKGYFDVWGQGTPVTVSSASTKGPSVFPLAPEVQLVQSGAEVKKPGSSVKVSCKASGYTFTDYEIHWVRQAPGQGLEWMGVNDPESGGTFYNQKFDGRVTLTADESTSTAYMELSSLRSEDTAVYYCTRYSKWDSFDGMDYWGQGTTVTVSS

SEQ ID NO: 171 - protein, 221 aa, Artificial Sequence; identical to SEQ ID NO: 51
  Description of Artificial Sequence: Synthetic polypeptide

SEQ ID NO: 172 - protein, 253 aa, Artificial Sequence
  Description of Artificial Sequence: Synthetic polypeptide
EVQLVQSGAEVKKPGSSVKVSCKASGYTFTDYEIHWVRQAPGQGLEWMGVNDPESGGTFYNQKFDGRVTLTADESTSTAYMELSSLRSEDTAVYYCTRYSKWDSFDGMDYWGQGTTVTVSSASTKGPSVFPLAPEVQLVESGGGVVQPGRSLRLSCSASGFIFSRYDMSWVRQAPGKGLEWVAYISHGGAGTYYPDSVKGRFTISRDNSKNTLFLQMDSLRPEDTGVYFCARGGVTKGYFDVWGQGTPVTVSS

SEQ ID NO: 173 - protein, 221 aa, Artificial Sequence; identical to SEQ ID NO: 53
  Description of Artificial Sequence: Synthetic polypeptide

SEQ ID NO: 174 - protein, 253 aa, Artificial Sequence
  Description of Artificial Sequence: Synthetic polypeptide
EVQLVESGGGVVQPGRSLRLSCSASGFIFSRYDMSWVRQAPGKGLEWVAYISHGGAGTYYPDSVKGRFTISRDNSKNTLFLQMDSLRAEDTAVYYCARGGVYKGYFDVWGQGTPVTVSSASTKGPSVFPLAPEVQLVQSGAEVKKPGSSVKVSCKASGYTFTDYEIHWVRQAPGQGLEWMGVNDPESGGTFYNQKFDGRVTLTADESTSTAYMELSSLRSEDTAVYYCTRYSKWDSFDGMDYWGQGTTVTVSS

SEQ ID NO: 175 - protein, 221 aa, Artificial Sequence; identical to SEQ ID NO: 51
  Description of Artificial Sequence: Synthetic polypeptide

SEQ ID NO: 176 - protein, 253 aa, Artificial Sequence
  Description of Artificial Sequence: Synthetic polypeptide
EVQLVQSGAEVKKPGSSVKVSCKASGYTFTDYEIHWVRQAPGQGLEWMGVNDPESGGTFYNQKFDGRVTLTADESTSTAYMELSSLRSEDTAVYYCTRYSKWDSFDGMDYWGQGTTVTVSSASTKGPSVFPLAPEVQLVESGGGVVQPGRSLRLSCSASGFIFSRYDMSWVRQAPGKGLEWVAYISHGGAGTYYPDSVKGRFTISRDNSKNTLFLQMDSLRAEDTAVYYCARGGVYKGYFDVWGQGTPVTVSS

SEQ ID NO: 177 - protein, 221 aa, Artificial Sequence; identical to SEQ ID NO: 53
  Description of Artificial Sequence: Synthetic polypeptide

SEQ ID NO: 178 - protein, 256 aa, Artificial Sequence
  Description of Artificial Sequence: Synthetic polypeptide
EVQLQESGPGLVKPSETLSLTCTVSGFSLSDYGVSWIRQPPGKGLEWLGLIWGGGDTYYNSPLKSRLTISKDNSKSQVSLKLSSVTAADTAVYYCAKQRTLWGYDLYGMDYWGQGTLVTVSSASTKGPSVFPLAPEVQLVQSGAEVKKPGSSVKVSCKASGYTFTDYEIHWVRQAPGQGLEWMGVNDPESGGTFYNQKFDGRVTLTADESTSTAYMELSSLRSEDTAVYYCTRYSKWDSFDGMDYWGQGTTVTVSS

SEQ ID NO: 179 - protein, 221 aa, Artificial Sequence; identical to SEQ ID NO: 59
  Description of Artificial Sequence: Synthetic polypeptide

SEQ ID NO: 180 - protein, 256 aa, Artificial Sequence
  Description of Artificial Sequence: Synthetic polypeptide
EVQLVQSGAEVKKPGSSVKVSCKASGYTFTDYEIHWVRQAPGQGLEWMGVNDPESGGTFYNQKFDGRVTLTADESTSTAYMELSSLRSEDTAVYYCTRYSKWDSFDGMDYWGQGTTVTVSSASTKGPSVFPLAPEVQLQESGPGLVKPSETLSLTCTVSGFSLSDYGVSWIRQPPGKGLEWLGLIWGGGDTYYNSPLKSRLTISKDNSKSQVSLKLSSVTAADTAVYYCAKQRTLWGYDLYGMDYWGQGTLVTVSS

SEQ ID NO: 181 - protein, 221 aa, Artificial Sequence; identical to SEQ ID NO: 61
  Description of Artificial Sequence: Synthetic polypeptide

SEQ ID NO: 182 - protein, 256 aa, Artificial Sequence; identical to SEQ ID NO: 178
  Description of Artificial Sequence: Synthetic polypeptide

SEQ ID NO: 183 - protein, 221 aa, Artificial Sequence; identical to SEQ ID NO: 63
  Description of Artificial Sequence: Synthetic polypeptide

SEQ ID NO: 184 - protein, 256 aa, Artificial Sequence; identical to SEQ ID NO: 180
  Description of Artificial Sequence: Synthetic polypeptide

SEQ ID NO: 185 - protein, 221 aa, Artificial Sequence; identical to SEQ ID NO: 65
  Description of Artificial Sequence: Synthetic polypeptide

SEQ ID NO: 186 - protein, 256 aa, Artificial Sequence
  Description of Artificial Sequence: Synthetic polypeptide
EVQLVESGGGLVQPGGSLRLSCAVSGFTLSDYGVSWIRQAPGKGLEWLGLIWGGGDTYYNSPLKSRLTISKDNSKSTVYLQMNSLRAEDTAVYYCAKQRTLWGYDLYGMDYWGQGTLVTVSSASTKGPSVFPLAPEVQLVQSGAEVKKPGSSVKVSCKASGYTFTDYEIHWVRQAPGQGLEWMGVNDPESGGTFYNQKFDGRVTLTADESTSTAYMELSSLRSEDTAVYYCTRYSKWDSFDGMDYWGQGTTVTVSS

SEQ ID NO: 187 - protein, 221 aa, Artificial Sequence; identical to SEQ ID NO: 67
  Description of Artificial Sequence: Synthetic polypeptide

SEQ ID NO: 188 - protein, 256 aa, Artificial Sequence
  Description of Artificial Sequence: Synthetic polypeptide
EVQLVQSGAEVKKPGSSVKVSCKASGYTFTDYEIHWVRQAPGQGLEWMGVNDPESGGTFYNQKFDGRVTLTADESTSTAYMELSSLRSEDTAVYYCTRYSKWDSFDGMDYWGQGTTVTVSSASTKGPSVFPLAPEVQLVESGGGLVQPGGSLRLSCAVSGFTLSDYGVSWIRQAPGKGLEWLGLIWGGGDTYYNSPLKSRLTISKDNSKSTVYLQMNSLRAEDTAVYYCAKQRTLWGYDLYGMDYWGQGTLVTVSS

SEQ ID NO: 189 - protein, 221 aa, Artificial Sequence; identical to SEQ ID NO: 69
  Description of Artificial Sequence: Synthetic polypeptide

SEQ ID NO: 190 - protein, 258 aa, Artificial Sequence
  Description of Artificial Sequence: Synthetic polypeptide
EVQLVESGGGVVQPGRSLRLSCSASGFIFSRYDMSWVRQAPGKGLEWVAYISHGGAGTYYPDSVKGRFTISRDNSKNTLFLQMDSLRPEDTGVYFCARGGVTKGYFDVWGQGTPVTVSSASTKGPSVFPLAPEVQLVQSGAEVKKPGSSVKVSCKASGGSFGGYGIGWVRQAPGQGLEWMGGITPFFGFADYAQKFQGRVTITADESTTTAYMELSGLTSDDTAVYYCARDPNEFWNGYYSTHDFDSWGQGTTVTVSS

SEQ ID NO: 191 - protein, 221 aa, Artificial Sequence; identical to SEQ ID NO: 71
  Description of Artificial Sequence: Synthetic polypeptide

SEQ ID NO: 192 - protein, 258 aa, Artificial Sequence
  Description of Artificial Sequence: Synthetic polypeptide
EVQLVQSGAEVKKPGSSVKVSCKASGGSFGGYGIGWVRQAPGQGLEWMGGITPFFGFADYAQKFQGRVTITADESTTTAYMELSGLTSDDTAVYYCARDPNEFWNGYYSTHDFDSWGQGTTVTVSSASTKGPSVFPLAPEVQLVESGGGVVQPGRSLRLSCSASGFIFSRYDMSWVRQAPGKGLEWVAYISHGGAGTYYPDSVKGRFTISRDNSKNTLFLQMDSLRPEDTGVYFCARGGVTKGYFDVWGQGTPVTVSS

SEQ ID NO: 193 - protein, 221 aa, Artificial Sequence; identical to SEQ ID NO: 73
  Description of Artificial Sequence: Synthetic polypeptide

SEQ ID NO: 194 - protein, 258 aa, Artificial Sequence
  Description of Artificial Sequence: Synthetic polypeptide
EVQLVESGGGVVQPGRSLRLSCSASGFIFSRYDMSWVRQAPGKGLEWVAYISHGGAGTYYPDSVKGRFTISRDNSKNTLFLQMDSLRAEDTAVYYCARGGVYKGYFDVWGQGTPVTVSSASTKGPSVFPLAPEVQLVQSGAEVKKPGSSVKVSCKASGGSFGGYGIGWVRQAPGQGLEWMGGITPFFGFADYAQKFQGRVTITADESTTTAYMELSGLTSDDTAVYYCARDPNEFWNGYYSTHDFDSWGQGTTVTVSS

SEQ ID NO: 195 - protein, 221 aa, Artificial Sequence; identical to SEQ ID NO: 71
  Description of Artificial Sequence: Synthetic polypeptide

SEQ ID NO: 196 - protein, 258 aa, Artificial Sequence
  Description of Artificial Sequence: Synthetic polypeptide
EVQLVQSGAEVKKPGSSVKVSCKASGGSFGGYGIGWVRQAPGQGLEWMGGITPFFGFADYAQKFQGRVTITADESTTTAYMELSGLTSDDTAVYYCARDPNEFWNGYYSTHDFDSWGQGTTVTVSSASTKGPSVFPLAPEVQLVESGGGVVQPGRSLRLSCSASGFIFSRYDMSWVRQAPGKGLEWVAYISHGGAGTYYPDSVKGRFTISRDNSKNTLFLQMDSLRAEDTAVYYCARGGVYKGYFDVWGQGTPVTVSS

SEQ ID NO: 197 - protein, 221 aa, Artificial Sequence; identical to SEQ ID NO: 73
  Description of Artificial Sequence: Synthetic polypeptide

SEQ ID NO: 198 - protein, 261 aa, Artificial Sequence
  Description of Artificial Sequence: Synthetic polypeptide
EVQLQESGPGLVKPSETLSLTCTVSGFSLSDYGVSWIRQPPGKGLEWLGLIWGGGDTYYNSPLKSRLTISKDNSKSQVSLKLSSVTAADTAVYYCAKQRTLWGYDLYGMDYWGQGTLVTVSSASTKGPSVFPLAPEVQLVQSGAEVKKPGSSVKVSCKASGGSFGGYGIGWVRQAPGQGLEWMGGITPFFGFADYAQKFQGRVTITADESTTTAYMELSGLTSDDTAVYYCARDPNEFWNGYYSTHDFDSWGQGTTVTVSS

SEQ ID NO: 199 - protein, 221 aa, Artificial Sequence; identical to SEQ ID NO: 79
  Description of Artificial Sequence: Synthetic polypeptide

SEQ ID NO: 200 - protein, 261 aa, Artificial Sequence
  Description of Artificial Sequence: Synthetic polypeptide
EVQLVQSGAEVKKPGSSVKVSCKASGGSFGGYGIGWVRQAPGQGLEWMGGITPFFGFADYAQKFQGRVTITADESTTTAYMELSGLTSDDTAVYYCARDPNEFWNGYYSTHDFDSWGQGTTVTVSSASTKGPSVFPLAPEVQLQESGPGLVKPSETLSLTCTVSGFSLSDYGVSWIRQPPGKGLEWLGLIWGGGDTYYNSPLKSRLTISKDNSKSQVSLKLSSVTAADTAVYYCAKQRTLWGYDLYGMDYWGQGTLVTVSS

SEQ ID NO: 201 - protein, 221 aa, Artificial Sequence; identical to SEQ ID NO: 81
  Description of Artificial Sequence: Synthetic polypeptide

SEQ ID NO: 202 - protein, 261 aa, Artificial Sequence; identical to SEQ ID NO: 198
  Description of Artificial Sequence: Synthetic polypeptide

SEQ ID NO: 203 - protein, 221 aa, Artificial Sequence; identical to SEQ ID NO: 83
  Description of Artificial Sequence: Synthetic polypeptide

SEQ ID NO: 204 - protein, 261 aa, Artificial Sequence; identical to SEQ ID NO: 200
  Description of Artificial Sequence: Synthetic polypeptide

SEQ ID NO: 205 - protein, 221 aa, Artificial Sequence; identical to SEQ ID NO: 85
  Description of Artificial Sequence: Synthetic polypeptide

SEQ ID NO: 206 - protein, 261 aa, Artificial Sequence
  Description of Artificial Sequence: Synthetic polypeptide
EVQLVESGGGLVQPGGSLRLSCAVSGFTLSDYGVSWIRQAPGKGLEWLGLIWGGGDTYYNSPLKSRLTISKDNSKSTVYLQMNSLRAEDTAVYYCAKQRTLWGYDLYGMDYWGQGTLVTVSSASTKGPSVFPLAPEVQLVQSGAEVKKPGSSVKVSCKASGGSFGGYGIGWVRQAPGQGLEWMGGITPFFGFADYAQKFQGRVTITADESTTTAYMELSGLTSDDTAVYYCARDPNEFWNGYYSTHDFDSWGQGTTVTVSS

SEQ ID NO: 207 - protein, 221 aa, Artificial Sequence; identical to SEQ ID NO: 87
  Description of Artificial Sequence: Synthetic polypeptide

SEQ ID NO: 208 - protein, 261 aa, Artificial Sequence
  Description of Artificial Sequence: Synthetic polypeptide
EVQLVQSGAEVKKPGSSVKVSCKASGGSFGGYGIGWVRQAPGQGLEWMGGITPFFGFADYAQKFQGRVTITADESTTTAYMELSGLTSDDTAVYYCARDPNEFWNGYYSTHDFDSWGQGTTVTVSSASTKGPSVFPLAPEVQLVESGGGLVQPGGSLRLSCAVSGFTLSDYGVSWIRQAPGKGLEWLGLIWGGGDTYYNSPLKSRLTISKDNSKSTVYLQMNSLRAEDTAVYYCAKQRTLWGYDLYGMDYWGQGTLVTVSS

SEQ ID NO: 209 - protein, 221 aa, Artificial Sequence; identical to SEQ ID NO: 89
  Description of Artificial Sequence: Synthetic polypeptide

SEQ ID NO: 210 - protein, 258 aa, Artificial Sequence
  Description of Artificial Sequence: Synthetic polypeptide
EVQLVESGGGVVQPGRSLRLSCSASGFIFSRYDMSWVRQAPGKGLEWVAYISHGGAGTYYPDSVKGRFTISRDNSKNTLFLQMDSLRPEDTGVYFCARGGVTKGYFDVWGQGTPVTVSSASTKGPSVFPLAPEVQLVQSGAEVKKPGESVKISCKASGGSFRSYGISWVRQAPGQGLEWMGGITHFFGITDYAQKFQGRVTITADESTTTAYMELSGLTSDDTAVYYCAREPNDFWNGYYDTHDFDSWGQGTTVTVSS

SEQ ID NO: 211 - protein, 221 aa, Artificial Sequence; identical to SEQ ID NO: 91
  Description of Artificial Sequence: Synthetic polypeptide

SEQ ID NO: 212 - protein, 258 aa, Artificial Sequence
  Description of Artificial Sequence: Synthetic polypeptide
EVQLVQSGAEVKKPGESVKISCKASGGSFRSYGISWVRQAPGQGLEWMGGITHFFGITDYAQKFQGRVTITADESTTTAYMELSGLTSDDTAVYYCAREPNDFWNGYYDTHDFDSWGQGTTVTVSSASTKGPSVFPLAPEVQLVESGGGVVQPGRSLRLSCSASGFIFSRYDMSWVRQAPGKGLEWVAYISHGGAGTYYPDSVKGRFTISRDNSKNTLFLQMDSLRPEDTGVYFCARGGVTKGYFDVWGQGTPVTVSS

SEQ ID NO: 213 - protein, 221 aa, Artificial Sequence; identical to SEQ ID NO: 93
  Description of Artificial Sequence: Synthetic polypeptide

SEQ ID NO: 214 - protein, 258 aa, Artificial Sequence
  Description of Artificial Sequence: Synthetic polypeptide
EVQLVESGGGVVQPGRSLRLSCSASGFIFSRYDMSWVRQAPGKGLEWVAYISHGGAGTYYPDSVKGRFTISRDNSKNTLFLQMDSLRAEDTAVYYCARGGVYKGYFDVWGQGTPVTVSSASTKGPSVFPLAPEVQLVQSGAEVKKPGESVKISCKASGGSFRSYGISWVRQAPGQGLEWMGGITHFFGITDYAQKFQGRVTITADESTTTAYMELSGLTSDDTAVYYCAREPNDFWNGYYDTHDFDSWGQGTTVTVSS

SEQ ID NO: 215 - protein, 221 aa, Artificial Sequence; identical to SEQ ID NO: 91
  Description of Artificial Sequence: Synthetic polypeptide

SEQ ID NO: 216 - protein, 258 aa, Artificial Sequence
  Description of Artificial Sequence: Synthetic polypeptide
EVQLVQSGAEVKKPGESVKISCKASGGSFRSYGISWVRQAPGQGLEWMGGITHFFGITDYAQKFQGRVTITADESTTTAYMELSGLTSDDTAVYYCAREPNDFWNGYYDTHDFDSWGQGTTVTVSSASTKGPSVFPLAPEVQLVESGGGVVQPGRSLRLSCSASGFIFSRYDMSWVRQAPGKGLEWVAYISHGGAGTYYPDSVKGRFTISRDNSKNTLFLQMDSLRAEDTAVYYCARGGVYKGYFDVWGQGTPVTVSS

SEQ ID NO: 217 - protein, 221 aa, Artificial Sequence; identical to SEQ ID NO: 93
  Description of Artificial Sequence: Synthetic polypeptide

SEQ ID NO: 218 - protein, 261 aa, Artificial Sequence
  Description of Artificial Sequence: Synthetic polypeptide
EVQLQESGPGLVKPSETLSLTCTVSGFSLSDYGVSWIRQPPGKGLEWLGLIWGGGDTYYNSPLKSRLTISKDNSKSQVSLKLSSVTAADTAVYYCAKQRTLWGYDLYGMDYWGQGTLVTVSSASTKGPSVFPLAPEVQLVQSGAEVKKPGESVKISCKASGGSFRSYGISWVRQAPGQGLEWMGGITHFFGITDYAQKFQGRVTITADESTTTAYMELSGLTSDDTAVYYCAREPNDFWNGYYDTHDFDSWGQGTTVTVSS

SEQ ID NO: 219 - protein, 221 aa, Artificial Sequence; identical to SEQ ID NO: 99
  Description of Artificial Sequence: Synthetic polypeptide

SEQ ID NO: 220 - protein, 261 aa, Artificial Sequence
  Description of Artificial Sequence: Synthetic polypeptide
EVQLVQSGAEVKKPGESVKISCKASGGSFRSYGISWVRQAPGQGLEWMGGITHFFGITDYAQKFQGRVTITADESTTTAYMELSGLTSDDTAVYYCAREPNDFWNGYYDTHDFDSWGQGTTVTVSSASTKGPSVFPLAPEVQLQESGPGLVKPSETLSLTCTVSGFSLSDYGVSWIRQPPGKGLEWLGLIWGGGDTYYNSPLKSRLTISKDNSKSQVSLKLSSVTAADTAVYYCAKQRTLWGYDLYGMDYWGQGTLVTVSS

SEQ ID NO: 221 - protein, 221 aa, Artificial Sequence; identical to SEQ ID NO: 101
  Description of Artificial Sequence: Synthetic polypeptide

SEQ ID NO: 222 - protein, 261 aa, Artificial Sequence; identical to SEQ ID NO: 218
  Description of Artificial Sequence: Synthetic polypeptide

SEQ ID NO: 223 - protein, 221 aa, Artificial Sequence; identical to SEQ ID NO: 103
  Description of Artificial Sequence: Synthetic polypeptide

SEQ ID NO: 224 - protein, 261 aa, Artificial Sequence; identical to SEQ ID NO: 220
  Description of Artificial Sequence: Synthetic polypeptide

SEQ ID NO: 225 - protein, 221 aa, Artificial Sequence; identical to SEQ ID NO: 105
  Description of Artificial Sequence: Synthetic polypeptide

SEQ ID NO: 226 - protein, 261 aa, Artificial Sequence
  Description of Artificial Sequence: Synthetic polypeptide
EVQLVESGGGLVQPGGSLRLSCAVSGFTLSDYGVSWIRQAPGKGLEWLGLIWGGGDTYYNSPLKSRLTISKDNSKSTVYLQMNSLRAEDTAVYYCAKQRTLWGYDLYGMDYWGQGTLVTVSSASTKGPSVFPLAPEVQLVQSGAEVKKPGESVKISCKASGGSFRSYGISWVRQAPGQGLEWMGGITHFFGITDYAQKFQGRVTITADESTTTAYMELSGLTSDDTAVYYCAREPNDFWNGYYDTHDFDSWGQGTTVTVSS

SEQ ID NO: 227 - protein, 221 aa, Artificial Sequence; identical to SEQ ID NO: 107
  Description of Artificial Sequence: Synthetic polypeptide

SEQ ID NO: 228 - protein, 261 aa, Artificial Sequence
  Description of Artificial Sequence: Synthetic polypeptide
EVQLVQSGAEVKKPGESVKISCKASGGSFRSYGISWVRQAPGQGLEWMGGITHFFGITDYAQKFQGRVTITADESTTTAYMELSGLTSDDTAVYYCAREPNDFWNGYYDTHDFDSWGQGTTVTVSSASTKGPSVFPLAPEVQLVESGGGLVQPGGSLRLSCAVSGFTLSDYGVSWIRQAPGKGLEWLGLIWGGGDTYYNSPLKSRLTISKDNSKSTVYLQMNSLRAEDTAVYYCAKQRTLWGYDLYGMDYWGQGTLVTVSS

SEQ ID NO: 229 - protein, 221 aa, Artificial Sequence; identical to SEQ ID NO: 109
  Description of Artificial Sequence: Synthetic polypeptide

SEQ ID NO: 230 - protein, 253 aa, Artificial Sequence; identical to SEQ ID NO: 170
  Description of Artificial Sequence: Synthetic polypeptide

SEQ ID NO: 231 - protein, 228 aa, Artificial Sequence; identical to SEQ ID NO: 111
  Description of Artificial Sequence: Synthetic polypeptide

SEQ ID NO: 232 - protein, 253 aa, Artificial Sequence; identical to SEQ ID NO: 172
  Description of Artificial Sequence: Synthetic polypeptide

SEQ ID NO: 233 - protein, 228 aa, Artificial Sequence; identical to SEQ ID NO: 113
  Description of Artificial Sequence: Synthetic polypeptide

SEQ ID NO: 234 - protein, 253 aa, Artificial Sequence; identical to SEQ ID NO: 174
  Description of Artificial Sequence: Synthetic polypeptide

SEQ ID NO: 235 - protein, 228 aa, Artificial Sequence; identical to SEQ ID NO: 111
  Description of Artificial Sequence: Synthetic polypeptide

SEQ ID NO: 236 - protein, 253 aa, Artificial Sequence; identical to SEQ ID NO: 176
  Description of Artificial Sequence: Synthetic polypeptide

SEQ ID NO: 237 - protein, 228 aa, Artificial Sequence; identical to SEQ ID NO: 113
  Description of Artificial Sequence: Synthetic polypeptide

SEQ ID NO: 238 - protein, 256 aa, Artificial Sequence; identical to SEQ ID NO: 178
  Description of Artificial Sequence: Synthetic polypeptide

SEQ ID NO: 239 - protein, 228 aa, Artificial Sequence; identical to SEQ ID NO: 119
  Description of Artificial Sequence: Synthetic polypeptide

SEQ ID NO: 240 - protein, 256 aa, Artificial Sequence; identical to SEQ ID NO: 180
  Description of Artificial Sequence: Synthetic polypeptide

SEQ ID NO: 241 - protein, 228 aa, Artificial Sequence; identical to SEQ ID NO: 121
  Description of Artificial Sequence: Synthetic polypeptide

SEQ ID NO: 242 - protein, 256 aa, Artificial Sequence; identical to SEQ ID NO: 178
  Description of Artificial Sequence: Synthetic polypeptide

SEQ ID NO: 243 - protein, 228 aa, Artificial Sequence; identical to SEQ ID NO: 123
  Description of Artificial Sequence: Synthetic polypeptide

SEQ ID NO: 244 - protein, 256 aa, Artificial Sequence; identical to SEQ ID NO: 180
  Description of Artificial Sequence: Synthetic polypeptide

SEQ ID NO: 245 - protein, 228 aa, Artificial Sequence; identical to SEQ ID NO: 125
  Description of Artificial Sequence: Synthetic polypeptide

SEQ ID NO: 246 - protein, 256 aa, Artificial Sequence; identical to SEQ ID NO: 186
  Description of Artificial Sequence: Synthetic polypeptide

SEQ ID NO: 247 - protein, 228 aa, Artificial Sequence; identical to SEQ ID NO: 127
  Description of Artificial Sequence: Synthetic polypeptide

SEQ ID NO: 248 - protein, 256 aa, Artificial Sequence; identical to SEQ ID NO: 188
  Description of Artificial Sequence: Synthetic polypeptide

SEQ ID NO: 249 - protein, 228 aa, Artificial Sequence; identical to SEQ ID NO: 129
  Description of Artificial Sequence: Synthetic polypeptide

SEQ ID NO: 250 - protein, 258 aa, Artificial Sequence; identical to SEQ ID NO: 190
  Description of Artificial Sequence: Synthetic polypeptide

SEQ ID NO: 251 - protein, 228 aa, Artificial Sequence; identical to SEQ ID NO: 131
  Description of Artificial Sequence: Synthetic polypeptide

SEQ ID NO: 252 - protein, 258 aa, Artificial Sequence; identical to SEQ ID NO: 192
  Description of Artificial Sequence: Synthetic polypeptide

SEQ ID NO: 253 - protein, 228 aa, Artificial Sequence; identical to SEQ ID NO: 133
  Description of Artificial Sequence: Synthetic polypeptide

SEQ ID NO: 254 - protein, 258 aa, Artificial Sequence; identical to SEQ ID NO: 194
  Description of Artificial Sequence: Synthetic polypeptide

SEQ ID NO: 255 - protein, 228 aa, Artificial Sequence; identical to SEQ ID NO: 131
  Description of Artificial Sequence: Synthetic polypeptide

SEQ ID NO: 256 - protein, 258 aa, Artificial Sequence; identical to SEQ ID NO: 196
  Description of Artificial Sequence: Synthetic polypeptide

SEQ ID NO: 257 - protein, 228 aa, Artificial Sequence; identical to SEQ ID NO: 133
  Description of Artificial Sequence: Synthetic polypeptide

SEQ ID NO: 258 - protein, 261 aa, Artificial Sequence; identical to SEQ ID NO: 198
  Description of Artificial Sequence: Synthetic polypeptide

SEQ ID NO: 259 - protein, 228 aa, Artificial Sequence; identical to SEQ ID NO: 139
  Description of Artificial Sequence: Synthetic polypeptide

SEQ ID NO: 260 - protein, 261 aa, Artificial Sequence; identical to SEQ ID NO: 200
  Description of Artificial Sequence: Synthetic polypeptide

SEQ ID NO: 261 - protein, 228 aa, Artificial Sequence; identical to SEQ ID NO: 141
  Description of Artificial Sequence: Synthetic polypeptide

SEQ ID NO: 262 - protein, 261 aa, Artificial Sequence; identical to SEQ ID NO: 198
  Description of Artificial Sequence: Synthetic polypeptide

SEQ ID NO: 263 - protein, 228 aa, Artificial Sequence; identical to SEQ ID NO: 143
  Description of Artificial Sequence: Synthetic polypeptide

SEQ ID NO: 264 - protein, 261 aa, Artificial Sequence; identical to SEQ ID NO: 200
  Description of Artificial Sequence: Synthetic polypeptide

SEQ ID NO: 265 - protein, 228 aa, Artificial Sequence; identical to SEQ ID NO: 145
  Description of Artificial Sequence: Synthetic polypeptide

SEQ ID NO: 266 - protein, 261 aa, Artificial Sequence; identical to SEQ ID NO: 206
  Description of Artificial Sequence: Synthetic polypeptide

SEQ ID NO: 267 - protein, 228 aa, Artificial Sequence; identical to SEQ ID NO: 147
  Description of Artificial Sequence: Synthetic polypeptide

SEQ ID NO: 268 - protein, 261 aa, Artificial Sequence; identical to SEQ ID NO: 208
  Description of Artificial Sequence: Synthetic polypeptide

SEQ ID NO: 269 - protein, 228 aa, Artificial Sequence; identical to SEQ ID NO: 149
  Description of Artificial Sequence: Synthetic polypeptide

SEQ ID NO: 270 - protein, 258 aa, Artificial Sequence; identical to SEQ ID NO: 210
  Description of Artificial Sequence: Synthetic polypeptide

SEQ ID NO: 271 - protein, 228 aa, Artificial Sequence; identical to SEQ ID NO: 151
  Description of Artificial Sequence: Synthetic polypeptide

SEQ ID NO: 272 - protein, 258 aa, Artificial Sequence; identical to SEQ ID NO: 212
  Description of Artificial Sequence: Synthetic polypeptide

SEQ ID NO: 273 - protein, 228 aa, Artificial Sequence; identical to SEQ ID NO: 153
  Description of Artificial Sequence: Synthetic polypeptide

SEQ ID NO: 274 - protein, 258 aa, Artificial Sequence; identical to SEQ ID NO: 214
  Description of Artificial Sequence: Synthetic polypeptide

SEQ ID NO: 275 - protein, 228 aa, Artificial Sequence; identical to SEQ ID NO: 151
  Description of Artificial Sequence: Synthetic polypeptide

SEQ ID NO: 276 - protein, 258 aa, Artificial Sequence; identical to SEQ ID NO: 216
  Description of Artificial Sequence: Synthetic polypeptide

SEQ ID NO: 277 - protein, 228 aa, Artificial Sequence; identical to SEQ ID NO: 153
  Description of Artificial Sequence: Synthetic polypeptide

SEQ ID NO: 278 - protein, 261 aa, Artificial Sequence; identical to SEQ ID NO: 218
  Description of Artificial Sequence: Synthetic polypeptide

SEQ ID NO: 279 - protein, 228 aa, Artificial Sequence; identical to SEQ ID NO: 159
  Description of Artificial Sequence: Synthetic polypeptide

SEQ ID NO: 280 - protein, 261 aa, Artificial Sequence; identical to SEQ ID NO: 220
  Description of Artificial Sequence: Synthetic polypeptide

SEQ ID NO: 281 - protein, 228 aa, Artificial Sequence; identical to SEQ ID NO: 161
  Description of Artificial Sequence: Synthetic polypeptide

SEQ ID NO: 282 - protein, 261 aa, Artificial Sequence; identical to SEQ ID NO: 218
  Description of Artificial Sequence: Synthetic polypeptide

SEQ ID NO: 283 - protein, 228 aa, Artificial Sequence; identical to SEQ ID NO: 163
  Description of Artificial Sequence: Synthetic polypeptide

SEQ ID NO: 284 - protein, 261 aa, Artificial Sequence; identical to SEQ ID NO: 220
  Description of Artificial Sequence: Synthetic polypeptide

SEQ ID NO: 285 - protein, 228 aa, Artificial Sequence; identical to SEQ ID NO: 165
  Description of Artificial Sequence: Synthetic polypeptide

SEQ ID NO: 286 - protein, 261 aa, Artificial Sequence; identical to SEQ ID NO: 226
  Description of Artificial Sequence: Synthetic polypeptide

SEQ ID NO: 287 - protein, 228 aa, Artificial Sequence; identical to SEQ ID NO: 167
  Description of Artificial Sequence: Synthetic polypeptide

SEQ ID NO: 288 - protein, 261 aa, Artificial Sequence; identical to SEQ ID NO: 228
  Description of Artificial Sequence: Synthetic polypeptide

SEQ ID NO: 289 - protein, 228 aa, Artificial Sequence; identical to SEQ ID NO: 169
  Description of Artificial Sequence: Synthetic polypeptide

SEQ ID NO: 290 - DNA, 7185 bp, Artificial Sequence
  Description of Artificial Sequence: Synthetic polynucleotide
gcgtcgaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgcgaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaatgagcggccgctcgaggccggcaaggccggatcccccgacctcgacctctggctaataaaggaaatttattttcattgcaatagtgtgttggaattttttgtgtctctcactcggaaggacatatgggagggcaaatcatttggtcgagatccctcggagatctctagctagaggatcgatccccgccccggacgaactaaacctgactacgacatctctgccccttcttcgcggggcagtgcatgtaatcccttcagttggttggtacaacttgccaactgggccctgttccacatgtgacacggggggggaccaaacacaaaggggttctctgactgtagttgacatccttataaatggatgtgcacatttgccaacactgagtggctttcatcctggagcagactttgcagtctgtggactgcaacacaacattgcctttatgtgtaactcttggctgaagctcttacaccaatgctgggggacatgtacctcccaggggcccaggaagactacgggaggctacaccaacgtcaatcagaggggcctgtgtagctaccgataagcggaccctcaagagggcattagcaatagtgtttataaggcccccttgttaaccctaaacgggtagcatatgcttcccgggtagtagtatatactatccagactaaccctaattcaatagcatatgttacccaacgggaagcatatgctatcgaattagggttagtaaaagggtcctaaggaacagcgatatctcccaccccatgagctgtcacggttttatttacatggggtcaggattccacgagggtagtgaaccattttagtcacaagggcagtggctgaagatcaaggagcgggcagtgaactctcctgaatcttcgcctgcttcttcattctccttcgtttagctaatagaataactgctgagttgtgaacagtaaggtgtatgtgaggtgctcgaaaacaaggtttcaggtgacgcccccagaataaaatttggacggggggttcagtggtggcattgtgctatgacaccaatataaccctcacaaaccccttgggcaataaatactagtgtaggaatgaaacattctgaatatctttaacaatagaaatccatggggtggggacaagccgtaaagactggatgtccatctcacacgaatttatggctatgggcaacacataatcctagtgcaatatgatactggggttattaagatgtgtcccaggcagggaccaagacaggtgaaccatgttgttacactctatttgtaacaaggggaaagagagtggacgccgacagcagcggactccactggttgtctctaacacccccgaaaattaaacggggctccacgccaatggggcccataaacaaagacaagtggccactcttttttttgaaattgtggagtgggggcacgcgtcagcccccacacgccgccctgcggttttggactgtaaaataagggtgtaataacttggctgattgtaaccccgctaaccactgcggtcaaaccacttgcccacaaaaccactaatggcaccccggggaatacctgcataagtaggtgggcgggccaagataggggcgcgattgctgcgatctggaggacaaattacacacacttgcgcctgagcgccaagcacagggttgttggtcctcatattcacgaggtcgctgagagcacggtgggctaatgttgccatgggtagcatatactacccaaatatctggatagcatatgctatcctaatctatatctgggtagcataggctatcctaatctatatctgggtagcatatgctatcctaatctatatctgggtagtatatgctatcctaatttatatctgggtagcataggctatcctaatctatatctgggtagcatatgctatcctaatctatatctgggtagtatatgctatcctaatctgtatccgggtagcatatgctatcctaatagagattagggtagtatatgctatcctaatttatatctgggtagcatatactacccaaatatctggatagcatatgctatcctaatctatatctgggtagcatatgctatcctaatctatatctgggtagcataggctatcctaatctatatctgggtagcatatgctatcctaatctatatctgggtagtatatgctatcctaatttatatctgggtagcataggctatcctaatctatatctgggtagcatatgctatcctaatctatatctgggtagtatatgctatcctaatctgtatccgggtagcatatgctatcctcatgataagctgtcaaacatgagaattttcttgaagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtgttgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgcagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagctctagctagaggtcgagtccctccccagcaggcagaagtatgcaaagcatgcatctcaattagtcagcaaccatagtcccgcccctaactccgcccatcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctttgcaaagatggataaagttttaaacagagaggaatctttgcagctaatggaccttctaggtcttgaaaggagtgggaattggctccggtgcccgtcagtgggcagagcgcacatcgcccacagtccccgagaagttggggggaggggtcggcaattgaaccggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacaggtaagtgccgtgtgtggttcccgcgggcctggcctctttacgggttatggcccttgcgtgccttgaattacttccacctggctgcagtacgtgattcttgatcccgagcttcgggttggaagtgggtgggagagttcgaggccttgcgcttaaggagccccttcgcctcgtgcttgagttgaggcctggcctgggcgctggggccgccgcgtgcgaatctggtggcaccttcgcgcctgtctcgctgctttcgataagtctctagccatttaaaatttttgatgacctgctgcgacgctttttttctggcaagatagtcttgtaaatgcgggccaagatctgcacactggtatttcggtttttggggccgcgggcggcgacggggcccgtgcgtcccagcgcacatgttcggcgaggcggggcctgcgagcgcggccaccgagaatcggacgggggtagtctcaagctggccggcctgctctggtgcctggcctcgcgccgccgtgtatcgccccgccctgggcggcaaggctggcccggtcggcaccagttgcgtgagcggaaagatggccgcttcccggccctgctgcagggagctcaaaatggaggacgcggcgctcgggagagcgggcgggtgagtcacccacacaaaggaaaagggcctttccgtcctcagccgtcgcttcatgtgactccacggagtaccgggcgccgtccaggcacctcgattagttctcgagcttttggagtacgtcgtctttaggttggggggaggggttttatgcgatggagtttccccacactgagtgggtggagactgaagttaggccagcttggcacttgatgtaattctccttggaatttgccctttttgagtttggatcttggttcattctcaagcctcagacagtggttcaaagtttttttcttccatttcaggtgtcgtgaggaattctctagagatccctcgacctcgagatccattgtgcccgggcgccaccatggagtttgggctgagctggctttttcttgtcgcgattttaaaaggtgtccagtgc

SEQ ID NO: 291 - DNA, 6521 bp, Artificial Sequence
  Description of Artificial Sequence: Synthetic polynucleotide
acggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgttgagcggccgctcgaggccggcaaggccggatcccccgacctcgacctctggctaataaaggaaatttattttcattgcaatagtgtgttggaattttttgtgtctctcactcggaaggacatatgggagggcaaatcatttggtcgagatccctcggagatctctagctagaggatcgatccccgccccggacgaactaaacctgactacgacatctctgccccttcttcgcggggcagtgcatgtaatcccttcagttggttggtacaacttgccaactgggccctgttccacatgtgacacggggggggaccaaacacaaaggggttctctgactgtagttgacatccttataaatggatgtgcacatttgccaacactgagtggctttcatcctggagcagactttgcagtctgtggactgcaacacaacattgcctttatgtgtaactcttggctgaagctcttacaccaatgctgggggacatgtacctcccaggggcccaggaagactacgggaggctacaccaacgtcaatcagaggggcctgtgtagctaccgataagcggaccctcaagagggcattagcaatagtgtttataaggcccccttgttaaccctaaacgggtagcatatgcttcccgggtagtagtatatactatccagactaaccctaattcaatagcatatgttacccaacgggaagcatatgctatcgaattagggttagtaaaagggtcctaaggaacagcgatatctcccaccccatgagctgtcacggttttatttacatggggtcaggattccacgagggtagtgaaccattttagtcacaagggcagtggctgaagatcaaggagcgggcagtgaactctcctgaatcttcgcctgcttcttcattctccttcgtttagctaatagaataactgctgagttgtgaacagtaaggtgtatgtgaggtgctcgaaaacaaggtttcaggtgacgcccccagaataaaatttggacggggggttcagtggtggcattgtgctatgacaccaatataaccctcacaaaccccttgggcaataaatactagtgtaggaatgaaacattctgaatatctttaacaatagaaatccatggggtggggacaagccgtaaagactggatgtccatctcacacgaatttatggctatgggcaacacataatcctagtgcaatatgatactggggttattaagatgtgtcccaggcagggaccaagacaggtgaaccatgttgttacactctatttgtaacaaggggaaagagagtggacgccgacagcagcggactccactggttgtctctaacacccccgaaaattaaacggggctccacgccaatggggcccataaacaaagacaagtggccactcttttttttgaaattgtggagtgggggcacgcgtcagcccccacacgccgccctgcggttttggactgtaaaataagggtgtaataacttggctgattgtaaccccgctaaccactgcggtcaaaccacttgcccacaaaaccactaatggcaccccggggaatacctgcataagtaggtgggcgggccaagataggggcgcgattgctgcgatctggaggacaaattacacacacttgcgcctgagcgccaagcacagggttgttggtcctcatattcacgaggtcgctgagagcacggtgggctaatgttgccatgggtagcatatactacccaaatatctggatagcatatgctatcctaatctatatctgggtagcataggctatcctaatctatatctgggtagcatatgctatcctaatctatatctgggtagtatatgctatcctaatttatatctgggtagcataggctatcctaatctatatctgggtagcatatgctatcctaatctatatctgggtagtatatgctatcctaatctgtatccgggtagcatatgctatcctaatagagattagggtagtatatgctatcctaatttatatctgggtagcatatactacccaaatatctggatagcatatgctatcctaatctatatctgggtagcatatgctatcctaatctatatctgggtagcataggctatcctaatctatatctgggtagcatatgctatcctaatctatatctgggtagtatatgctatcctaatttatatctgggtagcataggctatcctaatctatatctgggtagcatatgctatcctaatctatatctgggtagtatatgctatcctaatctgtatccgggtagcatatgctatcctcatgataagctgtcaaacatgagaattttcttgaagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtgttgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgcagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagctctagctagaggtcgagtccctccccagcaggcagaagtatgcaaagcatgcatctcaattagtcagcaaccatagtcccgcccctaactccgcccatcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctttgcaaagatggataaagttttaaacagagaggaatctttgcagctaatggaccttctaggtcttgaaaggagtgggaattggctccggtgcccgtcagtgggcagagcgcacatcgcccacagtccccgagaagttggggggaggggtcggcaattgaaccggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacaggtaagtgccgtgtgtggttcccgcgggcctggcctctttacgggttatggcccttgcgtgccttgaattacttccacctggctgcagtacgtgattcttgatcccgagcttcgggttggaagtgggtgggagagttcgaggccttgcgcttaaggagccccttcgcctcgtgcttgagttgaggcctggcctgggcgctggggccgccgcgtgcgaatctggtggcaccttcgcgcctgtctcgctgctttcgataagtctctagccatttaaaatttttgatgacctgctgcgacgctttttttctggcaagatagtcttgtaaatgcgggccaagatctgcacactggtatttcggtttttggggccgcgggcggcgacggggcccgtgcgtcccagcgcacatgttcggcgaggcggggcctgcgagcgcggccaccgagaatcggacgggggtagtctcaagctggccggcctgctctggtgcctggcctcgcgccgccgtgtatcgccccgccctgggcggcaaggctggcccggtcggcaccagttgcgtgagcggaaagatggccgcttcccggccctgctgcagggagctcaaaatggaggacgcggcgctcgggagagcgggcgggtgagtcacccacacaaaggaaaagggcctttccgtcctcagccgtcgcttcatgtgactccacggagtaccgggcgccgtccaggcacctcgattagttctcgagcttttggagtacgtcgtctttaggttggggggaggggttttatgcgatggagtttccccacactgagtgggtggagactgaagttaggccagcttggcacttgatgtaattctccttggaatttgccctttttgagtttggatcttggttcattctcaagcctcagacagtggttcaaagtttttttcttccatttcaggtgtcgtgaggaattctctagagatccctcgacctcgagatccattgtgcccgggcgcaccatggacatgcgcgtgcccgcccagctgctgggcctgctgctgctgtggttccccggctcgcgatgc

SEQ ID NO: 292 - DNA, 6513 bp, Artificial Sequence
  Description of Artificial Sequence: Synthetic polynucleotide
caacccaaggctgccccctcggtcactctgttcccgccctcctctgaggagcttcaagccaacaaggccacactggtgtgtctcataagtgacttctacccgggagccgtgacagtggcctggaaggcagatagcagccccgtcaaggcgggagtggagaccaccacaccctccaaacaaagcaacaacaagtacgcggccagcagctacctgagcctgacgcctgagcagtggaagtcccacagaagctacagctgccaggtcacgcatgaagggagcaccgtggagaagacagtggcccctacagaatgttcatgagcggccgctcgaggccggcaaggccggatcccccgacctcgacctctggctaataaaggaaatttattttcattgcaatagtgtgttggaattttttgtgtctctcactcggaaggacatatgggagggcaaatcatttggtcgagatccctcggagatctctagctagaggatcgatccccgccccggacgaactaaacctgactacgacatctctgccccttcttcgcggggcagtgcatgtaatcccttcagttggttggtacaacttgccaactgggccctgttccacatgtgacacggggggggaccaaacacaaaggggttctctgactgtagttgacatccttataaatggatgtgcacatttgccaacactgagtggctttcatcctggagcagactttgcagtctgtggactgcaacacaacattgcctttatgtgtaactcttggctgaagctcttacaccaatgctgggggacatgtacctcccaggggcccaggaagactacgggaggctacaccaacgtcaatcagaggggcctgtgtagctaccgataagcggaccctcaagagggcattagcaatagtgtttataaggcccccttgttaaccctaaacgggtagcatatgcttcccgggtagtagtatatactatccagactaaccctaattcaatagcatatgttacccaacgggaagcatatgctatcgaattagggttagtaaaagggtcctaaggaacagcgatatctcccaccccatgagctgtcacggttttatttacatggggtcaggattccacgagggtagtgaaccattttagtcacaagggcagtggctgaagatcaaggagcgggcagtgaactctcctgaatcttcgcctgcttcttcattctccttcgtttagctaatagaataactgctgagttgtgaacagtaaggtgtatgtgaggtgctcgaaaacaaggtttcaggtgacgcccccagaataaaatttggacggggggttcagtggtggcattgtgctatgacaccaatataaccctcacaaaccccttgggcaataaatactagtgtaggaatgaaacattctgaatatctttaacaatagaaatccatggggtggggacaagccgtaaagactggatgtccatctcacacgaatttatggctatgggcaacacataatcctagtgcaatatgatactggggttattaagatgtgtcccaggcagggaccaagacaggtgaaccatgttgttacactctatttgtaacaaggggaaagagagtggacgccgacagcagcggactccactggttgtctctaacacccccgaaaattaaacggggctccacgccaatggggcccataaacaaagacaagtggccactcttttttttgaaattgtggagtgggggcacgcgtcagcccccacacgccgccctgcggttttggactgtaaaataagggtgtaataacttggctgattgtaaccccgctaaccactgcggtcaaaccacttgcccacaaaaccactaatggcaccccggggaatacctgcataagtaggtgggcgggccaagataggggcgcgattgctgcgatctggaggacaaattacacacacttgcgcctgagcgccaagcacagggttgttggtcctcatattcacgaggtcgctgagagcacggtgggctaatgttgccatgggtagcatatactacccaaatatctggatagcatatgctatcctaatctatatctgggtagcataggctatcctaatctatatctgggtagcatatgctatcctaatctatatctgggtagtatatgctatcctaatttatatctgggtagcataggctatcctaatctatatctgggtagcatatgctatcctaatctatatctgggtagtatatgctatcctaatctgtatccgggtagcatatgctatcctaatagagattagggtagtatatgctatcctaatttatatctgggtagcatatactacccaaatatctggatagcatatgctatcctaatctatatctgggtagcatatgctatcctaatctatatctgggtagcataggctatcctaatctatatctgggtagcatatgctatcctaatctatatctgggtagtatatgctatcctaatttatatctgggtagcataggctatcctaatctatatctgggtagcatatgctatcctaatctatatctgggtagtatatgctatcctaatctgtatccgggtagcatatgctatcctcatgataagctgtcaaacatgagaattttcttgaagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtgttgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgcagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagctctagctagaggtcgagtccctccccagcaggcagaagtatgcaaagcatgcatctcaattagtcagcaaccatagtcccgcccctaactccgcccatcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctttgcaaagatggataaagttttaaacagagaggaatctttgcagctaatggaccttctaggtcttgaaaggagtgggaattggctccggtgcccgtcagtgggcagagcgcacatcgcccacagtccccgagaagttggggggaggggtcggcaattgaaccggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacaggtaagtgccgtgtgtggttcccgcgggcctggcctctttacgggttatggcccttgcgtgccttgaattacttccacctggctgcagtacgtgattcttgatcccgagcttcgggttggaagtgggtgggagagttcgaggccttgcgcttaaggagccccttcgcctcgtgcttgagttgaggcctggcctgggcgctggggccgccgcgtgcgaatctggtggcaccttcgcgcctgtctcgctgctttcgataagtctctagccatttaaaatttttgatgacctgctgcgacgctttttttctggcaagatagtcttgtaaatgcgggccaagatctgcacactggtatttcggtttttggggccgcgggcggcgacggggcccgtgcgtcccagcgcacatgttcggcgaggcggggcctgcgagcgcggccaccgagaatcggacgggggtagtctcaagctggccggcctgctctggtgcctggcctcgcgccgccgtgtatcgccccgccctgggcggcaaggctggcccggtcggcaccagttgcgtgagcggaaagatggccgcttcccggccctgctgcagggagctcaaaatggaggacgcggcgctcgggagagcgggcgggtgagtcacccacacaaaggaaaagggcctttccgtcctcagccgtcgcttcatgtgactccacggagtaccgggcgccgtccaggcacctcgattagttctcgagcttttggagtacgtcgtctttaggttggggggaggggttttatgcgatggagtttccccacactgagtgggtggagactgaagttaggccagcttggcacttgatgtaattctccttggaatttgccctttttgagtttggatcttggttcattctcaagcctcagacagtggttcaaagtttttttcttccatttcaggtgtcgtgaggaattctctagagatccctcgacctcgagatccattgtgcccgggcgccaccatgacttggaccccactcctcttcctcaccctcctcctccactgcacaggaagcttatcg

SEQ ID NO: 293 - DNA, 6515 bp, Artificial Sequence
  Description of Artificial Sequence: Synthetic polynucleotide
acggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgttgagcggccgctcgaggccggcaaggccggatcccccgacctcgacctctggctaataaaggaaatttattttcattgcaatagtgtgttggaattttttgtgtctctcactcggaaggacatatgggagggcaaatcatttggtcgagatccctcggagatctctagctagaggatcgatccccgccccggacgaactaaacctgactacgacatctctgccccttcttcgcggggcagtgcatgtaatcccttcagttggttggtacaacttgccaactgggccctgttccacatgtgacacggggggggaccaaacacaaaggggttctctgactgtagttgacatccttataaatggatgtgcacatttgccaacactgagtggctttcatcctggagcagactttgcagtctgtggactgcaacacaacattgcctttatgtgtaactcttggctgaagctcttacaccaatgctgggggacatgtacctcccaggggcccaggaagactacgggaggctacaccaacgtcaatcagaggggcctgtgtagctaccgataagcggaccctcaagagggcattagcaatagtgtttataaggcccccttgttaaccctaaacgggtagcatatgcttcccgggtagtagtatatactatccagactaaccctaattcaatagcatatgttacccaacgggaagcatatgctatcgaattagggttagtaaaagggtcctaaggaacagcgatatctcccaccccatgagctgtcacggttttatttacatggggtcaggattccacgagggtagtgaaccattttagtcacaagggcagtggctgaagatcaaggagcgggcagtgaactctcctgaatcttcgcctgcttcttcattctccttcgtttagctaatagaataactgctgagttgtgaacagtaaggtgtatgtgaggtgctcgaaaacaaggtttcaggtgacgcccccagaataaaatttggacggggggttcagtggtggcattgtgctatgacaccaatataaccctcacaaaccccttgggcaataaatactagtgtaggaatgaaacattctgaatatctttaacaatagaaatccatggggtggggacaagccgtaaagactggatgtccatctcacacgaatttatggctatgggcaacacataatcctagtgcaatatgatactggggttattaagatgtgtcccaggcagggaccaagacaggtgaaccatgttgttacactctatttgtaacaaggggaaagagagtggacgccgacagcagcggactccactggttgtctctaacacccccgaaaattaaacggggctccacgccaatggggcccataaacaaagacaagtggccactcttttttttgaaattgtggagtgggggcacgcgtcagcccccacacgccgccctgcggttttggactgtaaaataagggtgtaataacttggctgattgtaaccccgctaaccactgcggtcaaaccacttgcccacaaaaccactaatggcaccccggggaatacctgcataagtaggtgggcgggccaagataggggcgcgattgctgcgatctggaggacaaattacacacacttgcgcctgagcgccaagcacagggttgttggtcctcatattcacgaggtcgctgagagcacggtgggctaatgttgccatgggtagcatatactacccaaatatctggatagcatatgctatcctaatctatatctgggtagcataggctatcctaatctatatctgggtagcatatgctatcctaatctatatctgggtagtatatgctatcctaatttatatctgggtagcataggctatcctaatctatatctgggtagcatatgctatcctaatctatatctgggtagtatatgctatcctaatctgtatccgggtagcatatgctatcctaatagagattagggtagtatatgctatcctaatttatatctgggtagcatatactacccaaatatctggatagcatatgctatcctaatctatatctgggtagcatatgctatcctaatctatatctgggtagcataggctatcctaatctatatctgggtagcatatgctatcctaatctatatctgggtagtatatgctatcctaatttatatctgggtagcataggctatcctaatctatatctgggtagcatatgctatcctaatctatatctgggtagtatatgctatcctaatctgtatccgggtagcatatgctatcctcatgataagctgtcaaacatgagaattttcttgaagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtgttgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgcagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagctctagctagaggtcgagtccctccccagcaggcagaagtatgcaaagcatgcatctcaattagtcagcaaccatagtcccgcccctaactccgcccatcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctttgcaaagatggataaagttttaaacagagaggaatctttgcagctaatggaccttctaggtcttgaaaggagtgggaattggctccggtgcccgtcagtgggcagagcgcacatcgcccacagtccccgagaagttggggggaggggtcggcaattgaaccggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacaggtaagtgccgtgtgtggttcccgcgggcctggcctctttacgggttatggcccttgcgtgccttgaattacttccacctggctgcagtacgtgattcttgatcccgagcttcgggttggaagtgggtgggagagttcgaggccttgcgcttaaggagccccttcgcctcgtgcttgagttgaggcctggcctgggcgctggggccgccgcgtgcgaatctggtggcaccttcgcgcctgtctcgctgctttcgataagtctctagccatttaaaatttttgatgacctgctgcgacgctttttttctggcaagatagtcttgtaaatgcgggccaagatctgcacactggtatttcggtttttggggccgcgggcggcgacggggcccgtgcgtcccagcgcacatgttcggcgaggcggggcctgcgagcgcggccaccgagaatcggacgggggtagtctcaagctggccggcctgctctggtgcctggcctcgcgccgccgtgtatcgccccgccctgggcggcaaggctggcccggtcggcaccagttgcgtgagcggaaagatggccgcttcccggccctgctgcagggagctcaaaatggaggacgcggcgctcgggagagcgggcgggtgagtcacccacacaaaggaaaagggcctttccgtcctcagccgtcgcttcatgtgactccacggagtaccgggcgccgtccaggcacctcgattagttctcgagcttttggagtacgtcgtctttaggttggggggaggggttttatgcgatggagtttccccacactgagtgggtggagactgaagttaggccagcttggcacttgatgtaattctccttggaatttgccctttttgagtttggatcttggttcattctcaagcctcagacagtggttcaaagtttttttcttccatttcaggtgtcgtgaggaattctctagagatccctcgacctcgagatccattgtgcccgggcgcaccatgacttggaccccactcctcttcctcaccctcctcctccactgcacaggaagcttatcg

SEQ ID NO: 294 - DNA, 6519 bp, Artificial Sequence
  Description of Artificial Sequence: Synthetic polynucleotide
caacccaaggctgccccctcggtcactctgttcccgccctcctctgaggagcttcaagccaacaaggccacactggtgtgtctcataagtgacttctacccgggagccgtgacagtggcctggaaggcagatagcagccccgtcaaggcgggagtggagaccaccacaccctccaaacaaagcaacaacaagtacgcggccagcagctacctgagcctgacgcctgagcagtggaagtcccacagaagctacagctgccaggtcacgcatgaagggagcaccgtggagaagacagtggcccctacagaatgttcatgagcggccgctcgaggccggcaaggccggatcccccgacctcgacctctggctaataaaggaaatttattttcattgcaatagtgtgttggaattttttgtgtctctcactcggaaggacatatgggagggcaaatcatttggtcgagatccctcggagatctctagctagaggatcgatccccgccccggacgaactaaacctgactacgacatctctgccccttcttcgcggggcagtgcatgtaatcccttcagttggttggtacaacttgccaactgggccctgttccacatgtgacacggggggggaccaaacacaaaggggttctctgactgtagttgacatccttataaatggatgtgcacatttgccaacactgagtggctttcatcctggagcagactttgcagtctgtggactgcaacacaacattgcctttatgtgtaactcttggctgaagctcttacaccaatgctgggggacatgtacctcccaggggcccaggaagactacgggaggctacaccaacgtcaatcagaggggcctgtgtagctaccgataagcggaccctcaagagggcattagcaatagtgtttataaggcccccttgttaaccctaaacgggtagcatatgcttcccgggtagtagtatatactatccagactaaccctaattcaatagcatatgttacccaacgggaagcatatgctatcgaattagggttagtaaaagggtcctaaggaacagcgatatctcccaccccatgagctgtcacggttttatttacatggggtcaggattccacgagggtagtgaaccattttagtcacaagggcagtggctgaagatcaaggagcgggcagtgaactctcctgaatcttcgcctgcttcttcattctccttcgtttagctaatagaataactgctgagttgtgaacagtaaggtgtatgtgaggtgctcgaaaacaaggtttcaggtgacgcccccagaataaaatttggacggggggttcagtggtggcattgtgctatgacaccaatataaccctcacaaaccccttgggcaataaatactagtgtaggaatgaaacattctgaatatctttaacaatagaaatccatggggtggggacaagccgtaaagactggatgtccatctcacacgaatttatggctatgggcaacacataatcctagtgcaatatgatactggggttattaagatgtgtcccaggcagggaccaagacaggtgaaccatgttgttacactctatttgtaacaaggggaaagagagtggacgccgacagcagcggactccactggttgtctctaacacccccgaaaattaaacggggctccacgccaatggggcccataaacaaagacaagtggccactcttttttttgaaattgtggagtgggggcacgcgtcagcccccacacgccgccctgcggttttggactgtaaaataagggtgtaataacttggctgattgtaaccccgctaaccactgcggtcaaaccacttgcccacaaaaccactaatggcaccccggggaatacctgcataagtaggtgggcgggccaagataggggcgcgattgctgcgatctggaggacaaattacacacacttgcgcctgagcgccaagcacagggttgttggtcctcatattcacgaggtcgctgagagcacggtgggctaatgttgccatgggtagcatatactacccaaatatctggatagcatatgctatcctaatctatatctgggtagcataggctatcctaatctatatctgggtagcatatgctatcctaatctatatctgggtagtatatgctatcctaatttatatctgggtagcataggctatcctaatctatatctgggtagcatatgctatcctaatctatatctgggtagtatatgctatcctaatctgtatccgggtagcatatgctatcctaatagagattagggtagtatatgctatcctaatttatatctgggtagcatatactacccaaatatctggatagcatatgctatcctaatctatatctgggtagcatatgctatcctaatctatatctgggtagcataggctatcctaatctatatctgggtagcatatgctatcctaatctatatctgggtagtatatgctatcctaatttatatctgggtagcataggctatcctaatctatatctgggtagcatatgctatcctaatctatatctgggtagtatatgctatcctaatctgtatccgggtagcatatgctatcctcatgataagctgtcaaacatgagaattttcttgaagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtgttgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgcagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagctctagctagaggtcgagtccctccccagcaggcagaagtatgcaaagcatgcatctcaattagtcagcaaccatagtcccgcccctaactccgcccatcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctttgcaaagatggataaagttttaaacagagaggaatctttgcagctaatggaccttctaggtcttgaaaggagtgggaattggctccggtgcccgtcagtgggcagagcgcacatcgcccacagtccccgagaagttggggggaggggtcggcaattgaaccggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacaggtaagtgccgtgtgtggttcccgcgggcctggcctctttacgggttatggcccttgcgtgccttgaattacttccacctggctgcagtacgtgattcttgatcccgagcttcgggttggaagtgggtgggagagttcgaggccttgcgcttaaggagccccttcgcctcgtgcttgagttgaggcctggcctgggcgctggggccgccgcgtgcgaatctggtggcaccttcgcgcctgtctcgctgctttcgataagtctctagccatttaaaatttttgatgacctgctgcgacgctttttttctggcaagatagtcttgtaaatgcgggccaagatctgcacactggtatttcggtttttggggccgcgggcggcgacggggcccgtgcgtcccagcgcacatgttcggcgaggcggggcctgcgagcgcggccaccgagaatcggacgggggtagtctcaagctggccggcctgctctggtgcctggcctcgcgccgccgtgtatcgccccgccctgggcggcaaggctggcccggtcggcaccagttgcgtgagcggaaagatggccgcttcccggccctgctgcagggagctcaaaatggaggacgcggcgctcgggagagcgggcgggtgagtcacccacacaaaggaaaagggcctttccgtcctcagccgtcgcttcatgtgactccacggagtaccgggcgccgtccaggcacctcgattagttctcgagcttttggagtacgtcgtctttaggttggggggaggggttttatgcgatggagtttccccacactgagtgggtggagactgaagttaggccagcttggcacttgatgtaattctccttggaatttgccctttttgagtttggatcttggttcattctcaagcctcagacagtggttcaaagtttttttcttccatttcaggtgtcgtgaggaattctctagagatccctcgacctcgagatccattgtgcccgggcgccaccatggacatgcgcgtgcccgcccagctgctgggcctgctgctgctgtggttccccggctcgcgatgc

SEQ ID NO: 295 - DNA, 7185 bp, Artificial Sequence
  Description of Artificial Sequence: Synthetic polynucleotide
gcgtcgaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaagccgcggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgcgaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaatgagcggccgctcgaggccggcaaggccggatcccccgacctcgacctctggctaataaaggaaatttattttcattgcaatagtgtgttggaattttttgtgtctctcactcggaaggacatatgggagggcaaatcatttggtcgagatccctcggagatctctagctagaggatcgatccccgccccggacgaactaaacctgactacgacatctctgccccttcttcgcggggcagtgcatgtaatcccttcagttggttggtacaacttgccaactgggccctgttccacatgtgacacggggggggaccaaacacaaaggggttctctgactgtagttgacatccttataaatggatgtgcacatttgccaacactgagtggctttcatcctggagcagactttgcagtctgtggactgcaacacaacattgcctttatgtgtaactcttggctgaagctcttacaccaatgctgggggacatgtacctcccaggggcccaggaagactacgggaggctacaccaacgtcaatcagaggggcctgtgtagctaccgataagcggaccctcaagagggcattagcaatagtgtttataaggcccccttgttaaccctaaacgggtagcatatgcttcccgggtagtagtatatactatccagactaaccctaattcaatagcatatgttacccaacgggaagcatatgctatcgaattagggttagtaaaagggtcctaaggaacagcgatatctcccaccccatgagctgtcacggttttatttacatggggtcaggattccacgagggtagtgaaccattttagtcacaagggcagtggctgaagatcaaggagcgggcagtgaactctcctgaatcttcgcctgcttcttcattctccttcgtttagctaatagaataactgctgagttgtgaacagtaaggtgtatgtgaggtgctcgaaaacaaggtttcaggtgacgcccccagaataaaatttggacggggggttcagtggtggcattgtgctatgacaccaatataaccctcacaaaccccttgggcaataaatactagtgtaggaatgaaacattctgaatatctttaacaatagaaatccatggggtggggacaagccgtaaagactggatgtccatctcacacgaatttatggctatgggcaacacataatcctagtgcaatatgatactggggttattaagatgtgtcccaggcagggaccaagacaggtgaaccatgttgttacactctatttgtaacaaggggaaagagagtggacgccgacagcagcggactccactggttgtctctaacacccccgaaaattaaacggggctccacgccaatggggcccataaacaaagacaagtggccactcttttttttgaaattgtggagtgggggcacgcgtcagcccccacacgccgccctgcggttttggactgtaaaataagggtgtaataacttggctgattgtaaccccgctaaccactgcggtcaaaccacttgcccacaaaaccactaatggcaccccggggaatacctgcataagtaggtgggcgggccaagataggggcgcgattgctgcgatctggaggacaaattacacacacttgcgcctgagcgccaagcacagggttgttggtcctcatattcacgaggtcgctgagagcacggtgggctaatgttgccatgggtagcatatactacccaaatatctggatagcatatgctatcctaatctatatctgggtagcataggctatcctaatctatatctgggtagcatatgctatcctaatctatatctgggtagtatatgctatcctaatttatatctgggtagcataggctatcctaatctatatctgggtagcatatgctatcctaatctatatctgggtagtatatgctatcctaatctgtatccgggtagcatatgctatcctaatagagattagggtagtatatgctatcctaatttatatctgggtagcatatactacccaaatatctggatagcatatgctatcctaatctatatctgggtagcatatgctatcctaatctatatctgggtagcataggctatcctaatctatatctgggtagcatatgctatcctaatctatatctgggtagtatatgctatcctaatttatatctgggtagcataggctatcctaatctatatctgggtagcatatgctatcctaatctatatctgggtagtatatgctatcctaatctgtatccgggtagcatatgctatcctcatgataagctgtcaaacatgagaattttcttgaagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtgttgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgcagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagctctagctagaggtcgagtccctccccagcaggcagaagtatgcaaagcatgcatctcaattagtcagcaaccatagtcccgcccctaactccgcccatcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctttgcaaagatggataaagttttaaacagagaggaatctttgcagctaatggaccttctaggtcttgaaaggagtgggaattggctccggtgcccgtcagtgggcagagcgcacatcgcccacagtccccgagaagttggggggaggggtcggcaattgaaccggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacaggtaagtgccgtgtgtggttcccgcgggcctggcctctttacgggttatggcccttgcgtgccttgaattacttccacctggctgcagtacgtgattcttgatcccgagcttcgggttggaagtgggtgggagagttcgaggccttgcgcttaaggagccccttcgcctcgtgcttgagttgaggcctggcctgggcgctggggccgccgcgtgcgaatctggtggcaccttcgcgcctgtctcgctgctttcgataagtctctagccatttaaaatttttgatgacctgctgcgacgctttttttctggcaagatagtcttgtaaatgcgggccaagatctgcacactggtatttcggtttttggggccgcgggcggcgacggggcccgtgcgtcccagcgcacatgttcggcgaggcggggcctgcgagcgcggccaccgagaatcggacgggggtagtctcaagctggccggcctgctctggtgcctggcctcgcgccgccgtgtatcgccccgccctgggcggcaaggctggcccggtcggcaccagttgcgtgagcggaaagatggccgcttcccggccctgctgcagggagctcaaaatggaggacgcggcgctcgggagagcgggcgggtgagtcacccacacaaaggaaaagggcctttccgtcctcagccgtcgcttcatgtgactccacggagtaccgggcgccgtccaggcacctcgattagttctcgagcttttggagtacgtcgtctttaggttggggggaggggttttatgcgatggagtttccccacactgagtgggtggagactgaagttaggccagcttggcacttgatgtaattctccttggaatttgccctttttgagtttggatcttggttcattctcaagcctcagacagtggttcaaagtttttttcttccatttcaggtgtcgtgaggaattctctagagatccctcgacctcgagatccattgtgcccgggcgccaccatggagtttgggctgagctggctttttcttgtcgcgattttaaaaggtgtccagtgc

We claim:

1. A method for treating a subject for a disease or a disorder in which the activity of IL-17 is detrimental, comprising administering to the subject a binding protein comprising first and second polypeptide chains, each independently comprising VD1-(X1)n-VD2-C-(X2)n, wherein
   VD1 is a first variable domain;
   VD2 is a second variable domain;
   C is a constant domain;
   X1 is a linker;
   X2 is an Fc region;
   n is 0 or 1;
   wherein the VD1 domains on the first and second polypeptide chains form a first functional target binding site and the VD2 domains on the first and second polypeptide chains form a second functional target binding site,
   (a) wherein the binding protein is capable of binding IL-17, and wherein the variable domains that form a functional target binding site for IL-17 comprise CDRs 1-3 from SEQ ID NO: 40 and CDRs 1-3 from SEQ ID NO: 41;
   (b) wherein the binding protein is also capable of binding IL-1β or TNFα; and
   (c) wherein the disease or disorder is selected from the group consisting of rheumatoid arthritis, osteoarthritis, juvenile chronic arthritis, septic arthritis, Lyme arthritis, psoriatic arthritis, reactive arthritis, spondyloarthropathy, spondilitis anklyosans, systemic lupus erythematosus, Crohn's disease, ulcerative colitis, inflammatory bowel disease, psoriasis, sarcoidosis, uveitis, atopic eczema, scleroderma, and amyotrophic lateral sclerosis.

2. The method of claim 1, wherein the binding protein is administered parenterally, subcutaneously, intramuscularly, intravenously, intrarticularly, intrabronchially, intraabdominally, intracapsularly, intracartilaginously, intracavitarily, intracelially, intracerebellarly, intracerebroventricularly, intracolically, intracervically, intragastrically, intrahepatically, intramyocardially, intraosteally, intrapelvically, intrapericardially, intraperitoneally, intrapleurally, intraprostatically, intrapulmonarily, intrarectally, intrarenally, intraretinally, intraspinally, intrasynovially, intrathoracically intrauterine, intravesically, bolusly, vaginally, rectally, buccally, sublingually, intranasally, or transdermally.

3. The method of claim 1, wherein the variable domains that form a functional target binding site for IL-17 comprise SEQ ID NO: 40 and SEQ ID NO: 41.

4. The method of claim 1, wherein
   (a) X1 comprises any one of SEQ ID NOs: 1-29;
   (b) the binding protein is a crystallized binding protein;
   (c) the Fc region is a variant sequence Fc region;
   (d) the Fc region is from an IgG1, IgG2, IgG3, IgG4, IgA, IgM, IgE, or IgD; and/or
   (e) the binding protein comprises two first polypeptide chains and two second polypeptide chains and four functional target binding sites.

5. The method of claim 1, wherein the binding protein is capable of binding TNFα.

6. A method for treating a subject for a disease or a disorder in which the activity of IL-17 is detrimental, comprising administering to the subject a binding protein comprising first and second polypeptide chains; each independently comprising VD1-(X1)n-VD2-C-(X2)n, wherein
   VD1 is a first variable domain;
   VD2 is a second variable domain;
   C is a constant domain;
   X1 is a linker;
   X2 is an Fc region;
   n is 0 or 1;
   wherein the VD1 domains on the first and second polypeptide chains form a first functional target binding site and the VD2 domains on the first and second polypeptide chains form a second functional target binding site, wherein the binding protein is capable of binding IL-17 and TNFα, wherein
   (a) the variable domains that form a functional target binding site for IL-17 comprise SEQ ID NO: 40 and SEQ ID NO: 41;
   (b) X1 comprises SEQ ID NO: 29 on the first and second polypeptide chains;
   (c) the first polypeptide chain comprises an IgG1 variant heavy chain constant region comprising SEQ ID NO: 47 mutated at one or more amino acid residues; and
   (d) the second polypeptide chain comprises a light chain constant region of SEQ ID NO 48, and (e) wherein the disease or disorder is selected from the group consisting of rheumatoid arthritis, osteoarthritis, juvenile chronic arthritis, septic arthritis, Lyme arthritis, psoriatic arthritis, reactive arthritis, spondyloarthropathy, spondylitis ankylosans, systemic lupus erythematosus, Crohn's disease, ulcerative colitis, inflammatory bowel disease, psoriasis, sarcoidosis, uveitis, atopic eczema, scleroderma, and amyotrophic lateral sclerosis.

* * * * *